US012618069B2

(12) United States Patent
Freier

(10) Patent No.: US 12,618,069 B2
(45) Date of Patent: May 5, 2026

(54) COMPOUNDS AND METHODS FOR REDUCING ATXN3 EXPRESSION

(71) Applicant: Ionis Pharmaceuticals, Inc., Carlsbad, CA (US)

(72) Inventor: Susan M. Freier, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 18/485,724

(22) Filed: Oct. 12, 2023

(65) Prior Publication Data

US 2024/0301412 A1 Sep. 12, 2024

Related U.S. Application Data

(63) Continuation of application No. 17/852,939, filed on Jun. 29, 2022, now abandoned, which is a continuation of application No. 17/053,997, filed as application No. PCT/US2019/031562 on May 9, 2019, now Pat. No. 11,434,488.

(60) Provisional application No. 62/669,238, filed on May 9, 2018.

(51) Int. Cl.
*C12N 15/113* (2010.01)
*C12Q 1/68* (2018.01)

(52) U.S. Cl.
CPC ...... *C12N 15/113* (2013.01); *C12N 2310/315* (2013.01); *C12N 2310/322* (2013.01); *C12N 2310/3341* (2013.01); *C12N 2310/346* (2013.01); *C12N 2320/30* (2013.01)

(58) Field of Classification Search
None
See application file for complete search history.

(56) References Cited

U.S. PATENT DOCUMENTS

| | | | |
|---|---|---|---|
| 3,687,808 | A | 8/1972 | Merigan et al. |
| 4,415,732 | A | 11/1983 | Caruthers et al. |
| 4,469,863 | A | 9/1984 | Ts'o et al. |
| 4,476,301 | A | 10/1984 | Imbach et al. |
| 4,500,707 | A | 2/1985 | Caruthers et al. |
| 4,725,677 | A | 2/1988 | Koster et al. |
| 4,845,205 | A | 7/1989 | Huynh Dinh et al. |
| 4,973,679 | A | 11/1990 | Caruthers et al. |
| 4,981,957 | A | 1/1991 | Lebleu et al. |
| 5,013,830 | A | 5/1991 | Ohutsuka et al. |
| 5,023,243 | A | 6/1991 | Tullis |
| 5,034,506 | A | 7/1991 | Summerton et al. |
| 5,118,800 | A | 6/1992 | Smith et al. |
| 5,130,302 | A | 7/1992 | Spielvogel et al. |
| 5,132,418 | A | 7/1992 | Caruthers et al. |
| 5,134,066 | A | 7/1992 | Rogers et al. |
| RE34,036 | E | 8/1992 | McGeehan |
| 5,149,797 | A | 9/1992 | Pederson et al. |
| 5,166,315 | A | 11/1992 | Summerton et al. |
| 5,175,273 | A | 12/1992 | Bischofberger et al. |
| 5,177,196 | A | 1/1993 | Meyer, Jr. et al. |
| 5,177,198 | A | 1/1993 | Spielvogel et al. |
| 5,185,444 | A | 2/1993 | Summerton et al. |
| 5,188,897 | A | 2/1993 | Suhadolnik et al. |
| 5,194,599 | A | 3/1993 | Froehler et al. |
| 5,214,134 | A | 5/1993 | Weis et al. |
| 5,216,141 | A | 6/1993 | Benner |
| 5,220,007 | A | 6/1993 | Pederson et al. |
| 5,223,618 | A | 6/1993 | Cook et al. |
| 5,235,033 | A | 8/1993 | Summerton et al. |
| 5,256,775 | A | 10/1993 | Froehler |
| 5,264,423 | A | 11/1993 | Cohen et al. |
| 5,264,562 | A | 11/1993 | Matteucci |
| 5,264,564 | A | 11/1993 | Matteucci |
| 5,276,019 | A | 1/1994 | Cohen et al. |
| 5,286,717 | A | 2/1994 | Cohen et al. |
| 5,319,080 | A | 6/1994 | Leumann |
| 5,321,131 | A | 6/1994 | Agrawal et al. |
| 5,359,044 | A | 10/1994 | Cook et al. |
| 5,366,878 | A | 11/1994 | Pederson et al. |
| 5,367,066 | A | 11/1994 | Urdea et al. |
| 5,378,825 | A | 1/1995 | Cook et al. |
| 5,386,023 | A | 1/1995 | Sanghvi et al. |
| 5,393,878 | A | 2/1995 | Leumann |
| 5,399,676 | A | 3/1995 | Froehler |
| 5,403,711 | A | 4/1995 | Walder et al. |

(Continued)

FOREIGN PATENT DOCUMENTS

| | | |
|---|---|---|
| JP | 2011125219 | 6/2011 |
| WO | WO 2002/058626 | 8/2002 |

(Continued)

OTHER PUBLICATIONS

Alves et al., "Allele-Specific RNA Silencing of Mutant Ataxin-3 Mediates Neuroprotection in a Rat Model of Machado-Joseph Disease" PLoS ONE (2008) 3(10):e3341.
Alves et al., "Silencing ataxin-3 mitigates degeneration in a rat model of Machado-Joseph disease: no role for wild-type ataxin-3?" Hum. Mol. Gen. (2010) 19(12): 2380-2394.
Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

(Continued)

*Primary Examiner* — Sean McGarry
(74) *Attorney, Agent, or Firm* — McNeill PLLC

(57) ABSTRACT

Provided are compounds, methods, and pharmaceutical compositions for reducing the amount or activity of ATXN3 RNA in a cell or animal, and in certain embodiments reducing the amount of ATXN3 protein in a cell or animal. Such compounds, methods, and pharmaceutical compositions are useful to ameliorate at least one symptom or hallmark of a neurodegenerative disease. Such symptoms and hallmarks include motor dysfunction, aggregation formation, and neuron death. Such neurodegenerative diseases include spinocerebellar ataxia type 3 (SCA3).

39 Claims, No Drawings

Specification includes a Sequence Listing.

(56) References Cited

U.S. PATENT DOCUMENTS

| | | | |
|---|---|---|---|
| 5,405,938 | A | 4/1995 | Sumerton et al. |
| 5,405,939 | A | 4/1995 | Suhadolnik et al. |
| 5,432,272 | A | 7/1995 | Benner |
| 5,434,257 | A | 7/1995 | Matteucci |
| 5,446,137 | A | 8/1995 | Maag et al. |
| 5,453,496 | A | 9/1995 | Caruthers et al. |
| 5,455,233 | A | 10/1995 | Spielvogel et al. |
| 5,457,187 | A | 10/1995 | Gmelner et al. |
| 5,457,191 | A | 10/1995 | Cook et al. |
| 5,459,255 | A | 10/1995 | Cook et al. |
| 5,466,677 | A | 11/1995 | Baxter et al. |
| 5,466,786 | A | 11/1995 | Burh et al. |
| 5,470,967 | A | 11/1995 | Huie et al. |
| 5,476,925 | A | 12/1995 | Letsinger et al. |
| 5,484,908 | A | 1/1996 | Froehler et al. |
| 5,489,677 | A | 2/1996 | Sanghvi et al. |
| 5,491,133 | A | 2/1996 | Walder et al. |
| 5,502,177 | A | 3/1996 | Matteucci et al. |
| 5,508,270 | A | 4/1996 | Baxter et al. |
| 5,514,785 | A | 5/1996 | Van Ness et al. |
| 5,519,126 | A | 5/1996 | Hecht |
| 5,519,134 | A | 5/1996 | Acevedo et al. |
| 5,525,711 | A | 6/1996 | Hawkins et al. |
| 5,527,899 | A | 6/1996 | Froehler |
| 5,536,821 | A | 7/1996 | Agrawal et al. |
| 5,541,306 | A | 7/1996 | Agrawal et al. |
| 5,541,307 | A | 7/1996 | Cook et al. |
| 5,550,111 | A | 8/1996 | Suhadolnik et al. |
| 5,552,540 | A | 9/1996 | Haralambidis |
| 5,561,225 | A | 10/1996 | Maddry et al. |
| 5,563,253 | A | 10/1996 | Agrawal et al. |
| 5,565,350 | A | 10/1996 | Kmiec |
| 5,565,555 | A | 10/1996 | Froehler et al. |
| 5,567,811 | A | 10/1996 | Mistura et al. |
| 5,571,799 | A | 11/1996 | Tkachuk et al. |
| 5,576,427 | A | 11/1996 | Cook et al. |
| 5,587,361 | A | 12/1996 | Cook et al. |
| 5,587,469 | A | 12/1996 | Cook et al. |
| 5,587,470 | A | 12/1996 | Cook et al. |
| 5,591,722 | A | 1/1997 | Montgomery et al. |
| 5,594,121 | A | 1/1997 | Froehler et al. |
| 5,596,086 | A | 1/1997 | Matteucci |
| 5,596,091 | A | 1/1997 | Switzer |
| 5,597,909 | A | 1/1997 | Urdea et al. |
| 5,602,240 | A | 2/1997 | De Mesmaeker et al. |
| 5,608,046 | A | 3/1997 | Cook et al. |
| 5,610,289 | A | 3/1997 | Cook et al. |
| 5,610,300 | A | 3/1997 | Altmann et al. |
| 5,614,617 | A | 3/1997 | Cook et al. |
| 5,618,704 | A | 4/1997 | Sanghvi et al. |
| 5,623,065 | A | 4/1997 | Cook et al. |
| 5,623,070 | A | 4/1997 | Cook et al. |
| 5,625,050 | A | 4/1997 | Beaton et al. |
| 5,627,053 | A | 5/1997 | Usman et al. |
| 5,633,360 | A | 5/1997 | Bishofberger et al. |
| 5,639,873 | A | 6/1997 | Barascut et al. |
| 5,645,985 | A | 7/1997 | Froehler et al. |
| 5,646,265 | A | 7/1997 | McGee |
| 5,646,269 | A | 7/1997 | Matteucci |
| 5,652,355 | A | 7/1997 | Metelev et al. |
| 5,652,356 | A | 7/1997 | Agrawal |
| 5,663,312 | A | 9/1997 | Chaturvedula |
| 5,670,633 | A | 9/1997 | Cook et al. |
| 5,672,697 | A | 9/1997 | Buhr et al. |
| 5,677,437 | A | 10/1997 | Teng et al. |
| 5,677,439 | A | 10/1997 | Weis et al. |
| 5,681,941 | A | 10/1997 | Cook et al. |
| 5,698,685 | A | 12/1997 | Summerton et al. |
| 5,700,920 | A | 12/1997 | Altmann et al. |
| 5,700,922 | A | 12/1997 | Cook |
| 5,721,218 | A | 2/1998 | Froehler |
| 5,750,692 | A | 5/1998 | Cook et al. |
| 5,763,588 | A | 6/1998 | Matteucci et al. |
| 5,792,608 | A | 8/1998 | Swaminathan et al. |
| 5,792,847 | A | 8/1998 | Burh et al. |
| 5,801,154 | A | 9/1998 | Baracchini et al. |
| 5,808,027 | A | 9/1998 | Cook et al. |
| 5,830,653 | A | 11/1998 | Froehler et al. |
| 5,840,491 | A | 11/1998 | Kakizuka |
| 5,859,221 | A | 1/1999 | Cook et al. |
| 5,945,290 | A | 8/1999 | Cowsert et al. |
| 5,948,903 | A | 9/1999 | Cook et al. |
| 5,994,517 | A | 11/1999 | Ts'O |
| 6,005,087 | A | 12/1999 | Cook et al. |
| 6,005,096 | A | 12/1999 | Matteucci et al. |
| 6,166,199 | A | 12/2000 | Cook et al. |
| 6,255,051 | B1 | 7/2001 | Hammond et al. |
| 6,300,319 | B1 | 10/2001 | Manoharan |
| 6,426,220 | B1 | 7/2002 | Bennett et al. |
| 6,525,191 | B1 | 2/2003 | Ramasamy |
| 6,531,584 | B1 | 3/2003 | Cook et al. |
| 6,582,908 | B2 | 6/2003 | Fodor et al. |
| 6,600,032 | B1 | 7/2003 | Manoharan et al. |
| 6,660,720 | B2 | 12/2003 | Manoharan |
| 6,770,748 | B2 | 8/2004 | Imanishi et al. |
| 7,015,315 | B1 | 3/2006 | Cook et al. |
| 7,053,207 | B2 | 5/2006 | Wengel et al. |
| 7,101,993 | B1 | 9/2006 | Cook et al. |
| 7,250,289 | B2 | 7/2007 | Zhou |
| 7,262,177 | B2 | 8/2007 | Ts'o et al. |
| 7,399,845 | B2 | 7/2008 | Seth et al. |
| 7,427,672 | B2 | 9/2008 | Imanishi et al. |
| 7,491,805 | B2 | 2/2009 | Vargeese et al. |
| 7,547,684 | B2 | 6/2009 | Seth et al. |
| 7,569,686 | B1 | 8/2009 | Bhat et al. |
| 7,666,854 | B2 | 2/2010 | Seth et al. |
| 7,696,345 | B2 | 4/2010 | Allerson et al. |
| 7,723,509 | B2 | 5/2010 | Manoharan et al. |
| 7,741,457 | B2 | 6/2010 | Swayze et al. |
| 7,750,131 | B2 | 7/2010 | Seth et al. |
| 7,834,170 | B2 | 11/2010 | Khvorova et al. |
| 7,875,733 | B2 | 1/2011 | Bhat et al. |
| 7,939,677 | B2 | 5/2011 | Bhat et al. |
| 8,022,193 | B2 | 9/2011 | Swayze et al. |
| 8,030,467 | B2 | 10/2011 | Seth et al. |
| 8,080,644 | B2 | 12/2011 | Wengel et al. |
| 8,088,746 | B2 | 1/2012 | Seth et al. |
| 8,088,904 | B2 | 1/2012 | Swayze et al. |
| 8,106,022 | B2 | 1/2012 | Manoharan et al. |
| 8,124,745 | B2 | 2/2012 | Allerson et al. |
| 8,153,365 | B2 | 4/2012 | Wengel et al. |
| 8,178,503 | B2 | 5/2012 | Rigoutsos et al. |
| 8,263,760 | B2 | 9/2012 | De Kimpe et al. |
| 8,268,980 | B2 | 9/2012 | Seth et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,329,890 | B2 | 12/2012 | Davidson et al. |
| 8,440,803 | B2 | 5/2013 | Swayze et al. |
| 8,501,805 | B2 | 8/2013 | Seth et al. |
| 8,530,640 | B2 | 9/2013 | Seth et al. |
| 8,546,556 | B2 | 10/2013 | Seth et al. |
| RE44,779 | E | 2/2014 | Imanishi et al. |
| 8,779,116 | B2 | 7/2014 | Davidson et al. |
| 8,828,956 | B2 | 9/2014 | Manoharan et al. |
| 8,901,095 | B2 | 12/2014 | Corey et al. |
| 9,005,906 | B2 | 4/2015 | Swayze et al. |
| 9,012,421 | B2 | 4/2015 | Migawa et al. |
| 9,127,276 | B2 | 9/2015 | Prakash et al. |
| 9,290,760 | B2 | 3/2016 | Rajeev et al. |
| 9,340,785 | B2 | 5/2016 | Corey et al. |
| 9,487,779 | B2 | 11/2016 | Davidson et al. |
| 9,574,191 | B2 | 2/2017 | Corey et al. |
| 9,976,138 | B2 | 5/2018 | Prakash et al. |
| 10,041,074 | B2 | 8/2018 | Ozsolak |
| 10,364,432 | B2 | 7/2019 | Van Roon-Mom et al. |
| 10,533,175 | B2 | 1/2020 | Rigo et al. |
| 11,434,488 | B2 | 9/2022 | Freier |
| 11,583,548 | B2 | 2/2023 | Freier |
| 12,350,285 | B2 | 7/2025 | Freier et al. |
| 2001/0053519 | A1 | 12/2001 | Fodor et al. |
| 2003/0158403 | A1 | 8/2003 | Manoharan et al. |
| 2003/0175906 | A1 | 9/2003 | Manoharan et al. |
| 2003/0228597 | A1 | 12/2003 | Cowsert et al. |

(56) References Cited

U.S. PATENT DOCUMENTS

| | | | |
|---|---|---|---|
| 2004/0171570 | A1 | 9/2004 | Allerson et al. |
| 2004/0241651 | A1 | 12/2004 | Olek et al. |
| 2005/0130923 | A1 | 6/2005 | Bhat et al. |
| 2005/0244851 | A1 | 11/2005 | Blume et al. |
| 2005/0272080 | A1 | 12/2005 | Palma et al. |
| 2006/0148740 | A1 | 7/2006 | Platenburg |
| 2007/0031844 | A1 | 2/2007 | Khvorova et al. |
| 2008/0039618 | A1 | 2/2008 | Allerson et al. |
| 2010/0190837 | A1 | 7/2010 | Migawa et al. |
| 2010/0197762 | A1 | 8/2010 | Swayze et al. |
| 2011/0178283 | A1 | 7/2011 | Rigoutsos et al. |
| 2011/0190222 | A1 | 8/2011 | Corey et al. |
| 2013/0130378 | A1 | 5/2013 | Manoharan et al. |
| 2013/0198877 | A1 | 8/2013 | Van Roon-Mom et al. |
| 2013/0225659 | A1 | 8/2013 | Bennett |
| 2014/0039037 | A1 | 2/2014 | Roon-Mom et al. |
| 2014/0107330 | A1 | 4/2014 | Freier et al. |
| 2015/0018540 | A1 | 1/2015 | Prakash et al. |
| 2015/0184153 | A1 | 7/2015 | Freier et al. |
| 2015/0191727 | A1 | 7/2015 | Migawa et al. |
| 2015/0211006 | A1 | 7/2015 | Butler et al. |
| 2015/0267195 | A1 | 9/2015 | Seth et al. |
| 2015/0267197 | A1 | 9/2015 | Bennett et al. |
| 2015/0275212 | A1 | 10/2015 | Albaek et al. |
| 2015/0315595 | A1 | 11/2015 | Uzcategui et al. |
| 2016/0159846 | A1 | 6/2016 | Prakash et al. |
| 2016/0237429 | A1 | 8/2016 | Cubillos-Ruiz et al. |
| 2018/0258425 | A1 | 9/2018 | Rigo et al. |
| 2019/0247420 | A1 | 8/2019 | Freier et al. |
| 2022/0064637 | A1 | 3/2022 | Freier |
| 2023/0235323 | A1 | 7/2023 | Freier |
| 2024/0082291 | A1 | 3/2024 | Freier et al. |

FOREIGN PATENT DOCUMENTS

| | | |
|---|---|---|
| WO | WO 2004/013280 | 2/2004 |
| WO | WO 2004/045543 | 6/2004 |
| WO | WO 2004/058940 | 7/2004 |
| WO | WO 2006/006948 | 1/2006 |
| WO | WO 2008/021149 | 2/2008 |
| WO | WO 2010/014592 | 2/2010 |
| WO | WO 2011/097388 | 8/2011 |
| WO | WO 2011/097614 | 8/2011 |
| WO | WO 2011/097643 | 8/2011 |
| WO | WO 2012/012467 | 1/2012 |
| WO | WO 2012/018257 | 2/2012 |
| WO | WO 2013/033223 | 5/2013 |
| WO | WO 2013/138353 | 9/2013 |
| WO | WO 2013/173635 | 11/2013 |
| WO | WO 2013/173637 | 11/2013 |
| WO | WO 2015/017675 | 2/2015 |
| WO | WO 2015/053624 | 4/2015 |
| WO | WO 2015/089351 | 6/2015 |
| WO | WO 2015/143246 | 9/2015 |
| WO | WO 2017/053781 | 3/2017 |
| WO | WO 2018/002886 | 1/2018 |
| WO | WO 2018/089805 | 5/2018 |
| WO | WO 2019/217708 | 11/2019 |
| WO | WO 2020/172559 | 8/2020 |
| WO | WO 2020/245233 | 12/2020 |

OTHER PUBLICATIONS

Costa et al., "Toward RNAi therapy for the polyglutamine disease Machado-Joseph disease" Mol Ther (2013) 21: 1898-1908.

Crooke et al., "Basic Principles of Antisense Therapeutics" Antisense Research and Application (1998) Chapter 1:1-50.

Crooke, St., et al., "Antisense Drug Technology" Second Edition, CRC Press (2008) Chapters 1-28.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Evers et al., "Ataxin-3 Protein and RNA Toxicity in Spinocerebellar Ataxia Type 3: Current Insights and Emerging Therapeutic Strategies." Mol Neurobiol (2014) 49:1513-1531.

Evers et al., "Ataxin-3 protein modification as a treatment strategy for spinocerebellar ataxia type 3: Removal of the CAG containing exon" Neurobiloby of Disease (2013) 58: 49-56.

Extended EP Search report for 17869883.3 dated Jul. 16, 2020.

Extended EP Search report for 19799466.8 dated Jan. 14, 2022.

Fiszer et al., "Oligonucleotide-based strategies to combat polyglutamine diseases" Nucleic Acids Res (2014) 42: 6787-6810.

Gautschi et al., "Activity of a novel bel-2/bcl-xLbispecific antisense oligonucleotide against tumors of diverse histologic origins" J. Natl. Cancer Inst. (2001) 93:463-471.

GenBank Accession No. NM_004993.5 (downloaded Sep. 18, 2019).

Hu et al., "Allele-specific silencing of mutant huntingtin and ataxin-3 genes by targeting expanded CAG repeats in mRNAs." Nat. Biotech. (2009) 27(5): 478-484.

Hu et al., Allele-selective inhibition of ataxin-3 (ATX3) expression by antisense oligomers and duplex RNAs. Biol. Chem. (2011) 392(4): 315-325.

Hu et al., "Allele-selective inhibition of huntingtin expression by switching to an miRNA-like RNAi mechanism" Chem Biol (2010) 17(11): 1183-1188.

International Search Report for PCT/US17/61121 dated Apr. 26, 2018.

International Search Report for PCT/US19/031562 dated Sep. 17, 2019.

International Search Report for PCT/US20/019272 dated Jul. 1, 2020.

Kawaguchi et al., "CAG expansions in a novel gene for Machado-Joseph disease at chromosome 14q32.1." Nat. Genet. (1994) 8(3): 221-228.

Kenski et al., "siRNA-optimized Modifications for Enhanced In Vivo Activity" Mol Ther Nucleic Acids (2012) 1-8.

Liu et al., "ss-siRNAs allele selectively inhibit ataxin-3 expression: multiple mechanisms for an alternative gene silencing strategy." Nucleic Acids Res. (2013) 41(20): 9570-9583.

Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.

Mcloughlin et al., "Oligonucleotide therapy mitigates disease in Spinocerebellar Ataxia Type 3 mice." Annals of Neurology (2018) Accepted Article online Jun. 16, 2018, pp. 1-25.

Miller et al., "Allele-specific silencing of dominant disease genes." PNAS (2003) 100(12): 7195-7200.

Moore et al, "Evaluation of Antisense Oligonucleotides Targeting ATXN3 in SCA3 Mouse Models" Molecual Therapy:Nucliec Acids (2017) 7:200-210.

Moore et al, "Widespread In vivo suppression of mutant ATXN3 by antisense oligonucleotides in transgenic mouse models of SCA3" Society for Neuroscience 2016 Neuroscience meeting, San Diego, CA, Retreievd from the internet on Aug. 2, 2018, http://www.abstractsonline.com/pp8/#!/4071/presentation/6726.

Moore et al, "Widespread In vivo suppression of mutant ATXN3 by antisense oligonucleotides in transgenic mouse models of SCA3" Society for Neuroscience 2016 Neuroscience meeting, San Diego, CA, Poster Presentation Nov. 12, 2016.

New England Biolabs 1998/99 Catalog (cover page and pp. 121 and 284).

Partial Search Report for 16849742.8 dated Mar. 14, 2019.

Partial Search Report for 17869883.3 dated Apr. 24, 2020.

Reynolds et al., "Rational siRNA design for RNA interference" Nature Biotechnology (2004) 22(3):326-330.

Riess, et al., "SCA:3 Neurological features, patholgenesis and animal models." The Cerebellum (2008) 7:125-137.

Rodriguez-Lebron et al., "Silencing mutant ATXN3 expression resolves molecular phenotypes in SCA3 transgenic mice." Mol. Ther. (2013) 21(10): 1909-1918.

Sanghvi et al., "Heterocyclic Base Modifications in Nucleic Acids and Their Applications in Antisense Oligonucleotides" Antisense Research and Applications (1993) pp. 273-288.

(56) References Cited

OTHER PUBLICATIONS

Seidel et al., "Axonal inclusions in spinocerebellar ataxia type 3." Acta Neuropathol (2010) 120:449-460.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Toonen et al., "Antisense Oligonucleotide-Mediated Removal of the Polyglutamine Repeat in Spinocerebellar Ataxia Type 3 Mice" Mol Ther Nucleic Acids (2017) 8:232-242.
Toonen et al., "Ataxin-3 exon skipping as a treatment strategy for Spinocerebellar Ataxia type 3" Oligonucleotide Therapeutics Society 2015 Annual Meeting, Leiden, The Netherlands, Poster Presentaiton, Oct. 11, 2015.
Ward et al., "Ataxin-3, DAN damage repair, and SCA3 cerebellar degeneration: on the path to parsimony?" PLoS Genet (2015) 11(1):e1004937(1-4).
Woolf et al., "Specificity of antisense oligonucleotides in vivo" PNAS (1992) 89: 7305-7309.
Yu et al., "Single-stranded RNAs use RNAi to potently and allele-selectively inhibit mutant huntingtin expression" Cell (2012) 150(5): 895-908.
Partial Search Report for 20758529.0 dated Dec. 22, 2022.
Extended EP Search Report for 20758529.0 dated Mar. 23, 2023.

COMPOUNDS AND METHODS FOR REDUCING ATXN3 EXPRESSION

SEQUENCE LISTING

The present application is being filed along with a Sequence Listing in electronic format. The Sequence Listing is provided as a file entitled BIOL0331SEQ.xml, created on May 19, 2023, which is 2547 KB in size. The information in the electronic format of the sequence listing is incorporated herein by reference in its entirety.

FIELD

Provided are compounds, methods, and pharmaceutical compositions for reducing the amount or activity of ATXN3 RNA in a cell or animal, and in certain instances reducing the amount of Ataxin-3 protein in a cell or animal. Such compounds, methods, and pharmaceutical compositions are useful to ameliorate at least one symptom or hallmark of a neurodegenerative disease. Such symptoms and hallmarks include ataxia, neuropathy, and aggregate formation. Such neurodegenerative diseases include spinocerebellar ataxia type 3(SCA3).

BACKGROUND

Spinocerebellar ataxia type 3 (SCA3), also known as Machado-Joseph disease (MJD), is caused by a mutation in the ATXN3 gene and is characterized by progressive cerebellar ataxia and variable findings including a dystonic-rigid syndrome, a parkinsonian syndrome, or a combined syndrome of dystonia and peripheral neuropathy. SCA3 is inherited in an autosomal dominant manner. Offspring of affected individuals have a 50% chance of inheriting the mutation. The diagnosis of SCA3 rests on the use of molecular genetic testing to detect an abnormal CAG trinucleotide repeat expansion in ATXN3. Affected individuals have alleles with 52 to 86 CAG trinucleotide repeats. Such testing detects 100% of affected individuals. Expanded CAG repeats in the ATXN3 gene are translated into expanded polyglutamine repeats (polyQ) in the ataxin-3 protein and this toxic ataxin-3 protein is associated with aggregates. The polyglutamine expanded ataxin-3 protein in these aggregates is ubiquinated and the aggregates contain other proteins, including heat shock proteins and transcription factors. Aggregates are frequently observed in the brain tissue of SCA3 patients. Management of SCA3 is supportive as no medication slows the course of disease; restless legs syndrome and extrapyramidal syndromes resembling parkinsonism may respond to levodopa or dopamine agonists; spasticity, drooling, and sleep problems respond variably to lioresal, atropine-like drugs, and hypnotic agents; botulinum toxin has been used for dystonia and spasticity; daytime fatigue may respond to psychostimulants such as modafinil; accompanying depression should be treated. Riess, O., Rib, U., Pastore, A. et al. Cerebellum (2008) 7: 125.

Currently there is a lack of acceptable options for treating neurodegenerative diseases such as SCA3. It is therefore an object herein to provide compounds, methods, and pharmaceutical compositions for the treatment of such diseases.

SUMMARY OF THE INVENTION

Provided herein are compounds, methods, and pharmaceutical compositions for reducing the amount or activity of ATXN3 RNA, and in certain embodiments reducing the amount of Ataxin-3 protein in a cell or animal. In certain embodiments, the animal has a neurodegenerative disease. In certain embodiments, the animal has SCA3. In certain embodiments, compounds useful for reducing expression of ATXN3 RNA are oligomeric compounds. In certain embodiments, the oligomeric compound comprises a modified oligonucleotide.

Also provided are methods useful for ameliorating at least one symptom or hallmark of a neurodegenerative disease. In certain embodiments, the neurodegenerative disease is SCA3. In certain embodiments symptoms and hallmarks include ataxia, neuropathy, and aggregate formation. In certain embodiments, amelioration of these symptoms results in improved motor function, reduced neuropathy, and reduction in number of aggregates.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

As used herein, "2'-deoxynucleoside" means a nucleoside comprising a 2'-H(H) deoxyribosyl sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5-position. A 5-methyl cytosine is a modified nucleobase.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is ataxia, neuropathy, and aggregate formation. In certain embodiments, amelioration of these symptoms results in improved motor function, reduced neuropathy, or reduction in number of aggregates.

As used herein, "bicyclic nucleoside" or "BNA" means a nucleoside comprising a bicyclic sugar moiety. As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH)—O-2', and wherein the methyl group of the bridge is in the S configuration.

As used herein, "cEt nucleoside" means a nucleoside comprising cEt modified sugar.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "chirally controlled" in reference to an internucleoside linkage means chirality at that linkage is enriched for a particular stereochemical configuration.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-deoxyribosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "MOE" means methoxyethyl. "2'-MOE" or "2'-MOE modified sugar" means a 2'-$OCH_2CH_2OCH_3$ group in place of the 2'-OH group of a ribosyl sugar moiety.

As used herein, "2'-MOE nucleoside" means a nucleoside comprising a 2'-MOE modified sugar.

As used herein, "motif" means the pattern of unmodified and/or modified sugar moieties, nucleobases, and/or internucleoside linkages, in an oligonucleotide.

As used herein, "motif" means the pattern of unmodified and/or modified sugar moieties, nucleobases, and/or internucleoside linkages, in an oligonucleotide.

As used herein, "neurodegenerative disease" means a condition marked by progressive loss of structure or function of neurons, including death of neurons. In certain embodiments, neurodegenerative disease is spinocerebellar ataxia type 3 (SCA3).

As used herein, "nucleobase" means an unmodified nucleobase or a modified nucleobase. As used herein an "unmodified nucleobase" is adenine (A), thymine (T), cytosine (C), uracil (U), and guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution, or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "phosphorus moiety" means a group of atoms comprising a phosphorus atom. In certain embodiments, a phosphorus moiety comprises a mono-, di-, or tri-phosphate, or phosphorothioate.

As used herein "prodrug" means a therapeutic agent in a form outside the body that is converted to a different form within an animal or cells thereof. Typically, conversion of a prodrug within the animal is facilitated by the action of an enzyme (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard cell assay" means the assay described in Example 1 and reasonable variations thereof.

As used herein, "standard in vivo assay" means the experiment described in Example 4 and reasonable variations thereof.

As used herein, "stereorandom" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the results of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

CERTAIN EMBODIMENTS

The present disclosure provides the following non-limiting numbered embodiments:

Embodiment 1. An oligomeric compound, comprising a modified oligonucleotide consisting of 12 to 50 linked nucleosides wherein the nucleobase sequence of the modified oligonucleotide is at least 90% complementary to an equal length portion of an ATXN3 nucleic acid, and wherein the modified oligonucleotide comprises at least one modification selected from a modified sugar, a sugar surrogate, and a modified internucleoside linkage.

Embodiment 2. An oligomeric compound, comprising a modified oligonucleotide consisting of 12 to 50 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases of any of the nucleobase sequences of SEQ ID NOs: 15-2787.

Embodiment 3. An oligomeric compound comprising a modified oligonucleotide consisting of 12 to 50 linked nucleosides and having a nucleobase sequence comprising a portion of at least 8, at least 9, at least 10, at least 11, at least 12, at least 13, at least 14, at least 15, at least 16, at least 17, at least 18, at least 19, or at least 20 contiguous nucleobases, wherein the portion is complementary to:

- an equal length portion of nucleobases 138-175 of SEQ ID NO: 1;
- an equal length portion of nucleobases 392-436 of SEQ ID NO: 1;
- an equal length portion of nucleobases 1120-1146 of SEQ ID NO: 1;
- an equal length portion of nucleobases 1823-1882 of SEQ ID NO: 1;
- an equal length portion of nucleobases 3042-3098 of SEQ ID NO: 1;
- an equal length portion of nucleobases 3749-3801 of SEQ ID NO: 1;
- an equal length portion of nucleobases 5997-6021 of SEQ ID NO: 1;
- an equal length portion of nucleobases 19437-19476 of SEQ ID NO: 2;
- an equal length portion of nucleobases 34440-34486 of SEQ ID NO: 2;
- an equal length portion of nucleobases 39883-39904 of SEQ ID NO: 2; or
- an equal length portion of nucleobases 6597-6618 of SEQ ID NO: 2.

Embodiment 4. The oligomeric compound of any one of embodiments 1-3, wherein the ATXN3 nucleic acid has the nucleobase sequence of any of SEQ ID NOs: 1, 2, 3, 4, or 5.

Embodiment 5. The oligomeric compound of any one of embodiments 1-4, consisting of a single-stranded modified oligonucleotide.

Embodiment 6. The oligomeric compound of any one of embodiments 1-5, wherein at least one internucleoside linkage of the modified oligonucleotide is a modified internucleoside linkage.

Embodiment 7. The oligomeric compound of embodiment 6, wherein the modified internucleoside linkage is a phosphorothioate internucleoside linkage.

Embodiment 8. The oligomeric compound of any one of embodiments 1-5, wherein each internucleoside linkage of the modified oligonucleotide is a modified internucleoside linkage.

Embodiment 9. The oligomeric compound of embodiment 8, wherein each modified internucleoside linkage of the modified oligonucleotide is a phosphorothioate internucleoside linkage.

Embodiment 10. The oligomeric compound of any one of embodiments 1-7, wherein at least one internucleoside linkage of the modified oligonucleotide is a phosphodiester internucleoside linkage.

Embodiment 11. The oligomeric compound of any one of embodiments 1-7 and 10, wherein each internucleoside linkage of the modified oligonucleotide is either a phosphodiester internucleoside linkage or a phosphorothioate internucleoside linkage.

Embodiment 12. The oligomeric compound of any one of embodiments 1-11, wherein at least one nucleobase of the modified oligonucleotide comprises a modified nucleobase.

Embodiment 13. The oligomeric compound of embodiment 12, wherein the modified nucleobase is a 5-methyl cytosine.

Embodiment 14. The oligomeric compound of any one of embodiments 1-13, wherein the modified oligonucleotide comprises at least one modified nucleoside comprising a modified sugar moiety.

Embodiment 15. The oligomeric compound of embodiment 14, wherein the modified oligonucleotide comprises at least one modified nucleoside comprising a bicyclic sugar moiety.

Embodiment 16. The oligomeric compound of embodiment 15, wherein the modified oligonucleotide comprises at least one modified nucleoside comprising a bicyclic sugar moiety having a 2'-4' bridge, wherein the 2'-4' bridge is selected from —O—CH2-; and —O—CH(CH3)-.

Embodiment 17. The oligomeric compound of any of embodiments 1-13, wherein the modified oligonucleotide comprises at least one modified nucleoside comprising a non-bicyclic sugar moiety.

Embodiment 18. The oligomeric compound of embodiment 17, wherein the modified oligonucleotide comprises at least one modified nucleoside comprising a modified non-bicyclic sugar moiety comprising a 2'-MOE or 2'-OMe.

Embodiment 19. The oligomeric compound of embodiment 18, wherein each modified nucleoside of the modified oligonucleotide comprises a modified non-bicyclic sugar moiety comprising a 2'-MOE or 2'-OMe.

Embodiment 20. The oligomeric compound of any of embodiments 1-13, wherein the modified oligonucleotide comprises at least one modified nucleoside comprising a sugar surrogate.

Embodiment 21. The oligomeric compound of embodiment 20, wherein the modified oligonucleotide comprises at least one modified nucleoside comprising a sugar surrogate selected from morpholino and PNA.

Embodiment 22. The oligomeric compound of any of embodiments 1-18 and 20-21, wherein the modified oligonucleotide is a gapmer.

Embodiment 23. The oligomeric compound of any of embodiments 1-18 and 20-21, wherein the modified oligonucleotide has a sugar motif comprising:

- a 5'-region consisting of 1-6 linked 5'-nucleosides;
- a central region consisting of 6-10 linked central region nucleosides; and
- a 3'-region consisting of 1-6 linked 5'-nucleosides; wherein each of the 5'-region nucleosides and each of the 3'-region nucleosides comprises a modified sugar moiety and each of the central region nucleosides comprises a 2'-deoxyribosyl sugar moiety.

Embodiment 24. The oligomeric compound of embodiments 1-7 or 10-23, wherein the modified oligonucleotide consists of 20 linked nucleosides and has the following internucleoside motif: sooosssssssssssooss; wherein, s=a phosphorothioate internucleoside linkage, and o=a phosphodiester internucleoside linkage.

Embodiment 25. The oligomeric compound of any one of embodiments 1-23, wherein the modified oligonucleotide consists of 12-22, 12-20, 14-20, 16-20, 18-20, or 18-22 linked nucleosides.

Embodiment 26. The oligomeric compound of any one of embodiments 1-23 and 25, wherein the modified oligonucleotide consists of 16, 17, 18, 19, or 20 linked nucleosides.

Embodiment 27. The oligomeric compound of any of embodiments 1-26 consisting of the modified oligonucleotide.

Embodiment 28. The oligomeric compound of any of embodiments 1-26 comprising a conjugate group comprising a conjugate moiety and a conjugate linker.

Embodiment 29. The oligomeric compound of embodiment 28, wherein the conjugate group comprises a GalNAc cluster comprising 1-3 GalNAc ligands.

Embodiment 30. The oligomeric compound of embodiment 28 or 29, wherein the conjugate linker consists of a single bond.

Embodiment 31. The oligomeric compound of embodiment 28, wherein the conjugate linker is cleavable.

Embodiment 32. The oligomeric compound of embodiment 28, wherein the conjugate linker comprises 1-3 linker-nucleosides.

Embodiment 33. The oligomeric compound of any of embodiments 28-32, wherein the conjugate group is attached to the modified oligonucleotide at the 5'-end of the modified oligonucleotide.

Embodiment 34. The oligomeric compound of any of embodiments 28-32, wherein the conjugate group is attached to the modified oligonucleotide at the 3'-end of the modified oligonucleotide.

Embodiment 35. The oligomeric compound of any of embodiments 1-26 or 28-34 comprising a terminal group.

Embodiment 36. The oligomeric compound of any of embodiments 1-35 wherein the oligomeric compound is a singled-stranded oligomeric compound.

Embodiment 37. The oligomeric compound of any of embodiments 1-31 or 33-34, wherein the oligomeric compound does not comprise linker-nucleosides.

Embodiment 38. An oligomeric duplex comprising an oligomeric compound of any of embodiments 1-35 and 37.

Embodiment 39. An antisense compound comprising or consisting of an oligomeric compound of any of embodiments 1-37 or an oligomeric duplex of embodiment 38.

Embodiment 40. A modified oligonucleotide consisting of 12 to 50 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases of any of the nucleobase sequences of SEQ ID NOs: 15-2787.

Embodiment 41. A pharmaceutical composition comprising an oligomeric compound of any of embodiments 1-37, an oligomeric duplex of embodiment 38, an antisense compound of embodiment 39, or a modified oligonucleotide of embodiment 40 and at least one of a pharmaceutically acceptable carrier or diluent.

Embodiment 42. The pharmaceutical composition of embodiment 41, wherein the modified oligonucleotide is a sodium salt.

Embodiment 43. A method comprising administering to an animal the pharmaceutical composition of any of embodiments 41-42.

Embodiment 44. The method of embodiment 43, wherein the animal is a human.

Embodiment 45. A method of treating a disease associated with ATXN3 comprising administering to an individual having or at risk for developing a disease associated with ATXN3 a therapeutically effective amount of a pharmaceutical composition of embodiments 41 and 42, and thereby treating the disease associated with ATXN3.

Embodiment 46. The method of embodiment 45, wherein the disease associated with ATXN3 is a neurodegenerative disease.

Embodiment 47. The method of embodiment 46, wherein the neurodegenerative disease is SCA3.

Embodiment 48. The method of embodiment 47, wherein at least one symptom or hallmark of the neurodegenerative disease is ameliorated.

Embodiment 49. The method of embodiment 48, wherein the symptom or hallmark is ataxia, neuropathy, and aggregate formation.

Embodiment 50. A modified oligonucleotide according to the following chemical structure:

(SEQ ID NO: 2807)

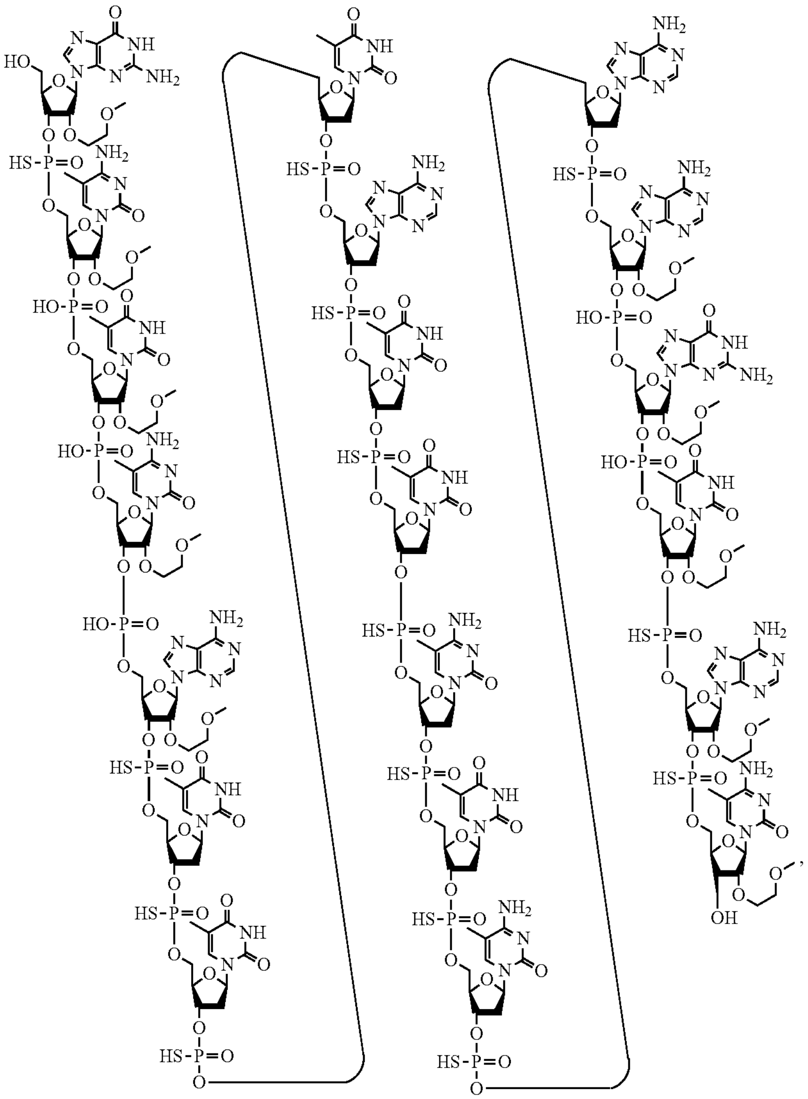

or a salt thereof.

Embodiment 51. A modified oligonucleotide according to the following chemical structure:

(SEQ ID NO: 2808)
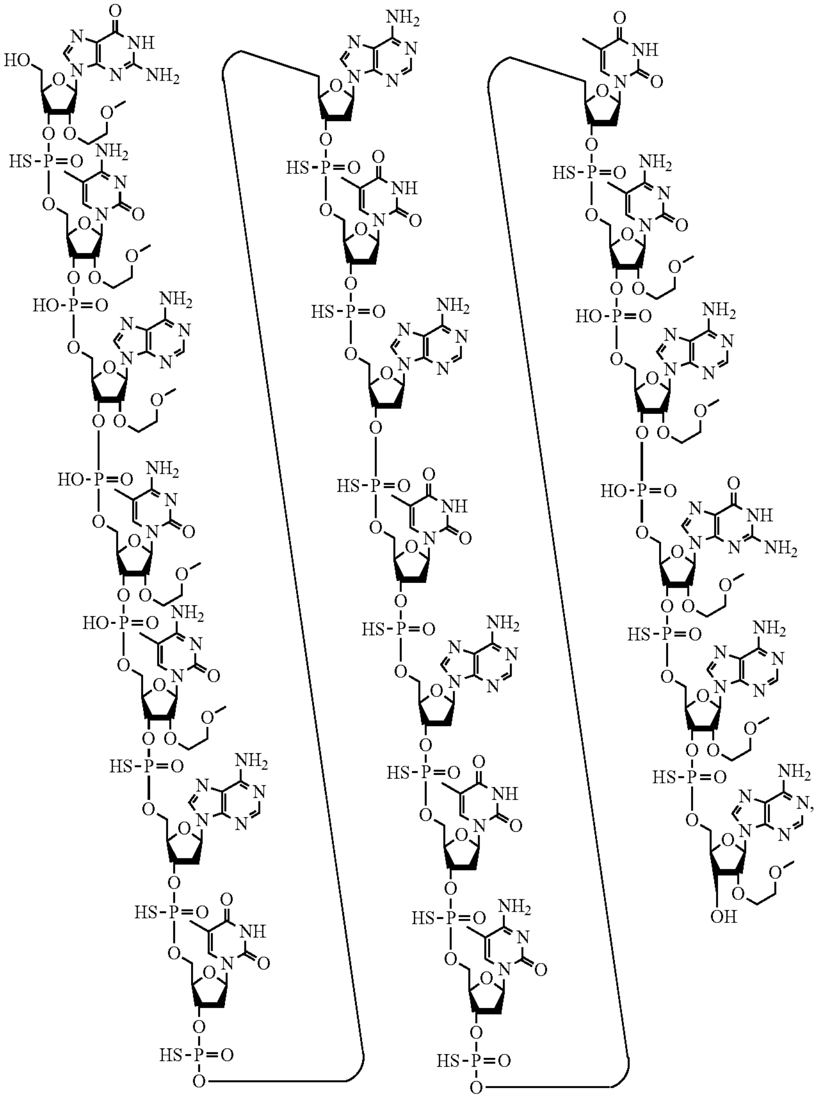
or a salt thereof.
Embodiment 52. A modified oligonucleotide according to the following chemical structure:

(SEQ ID NO: 2809)
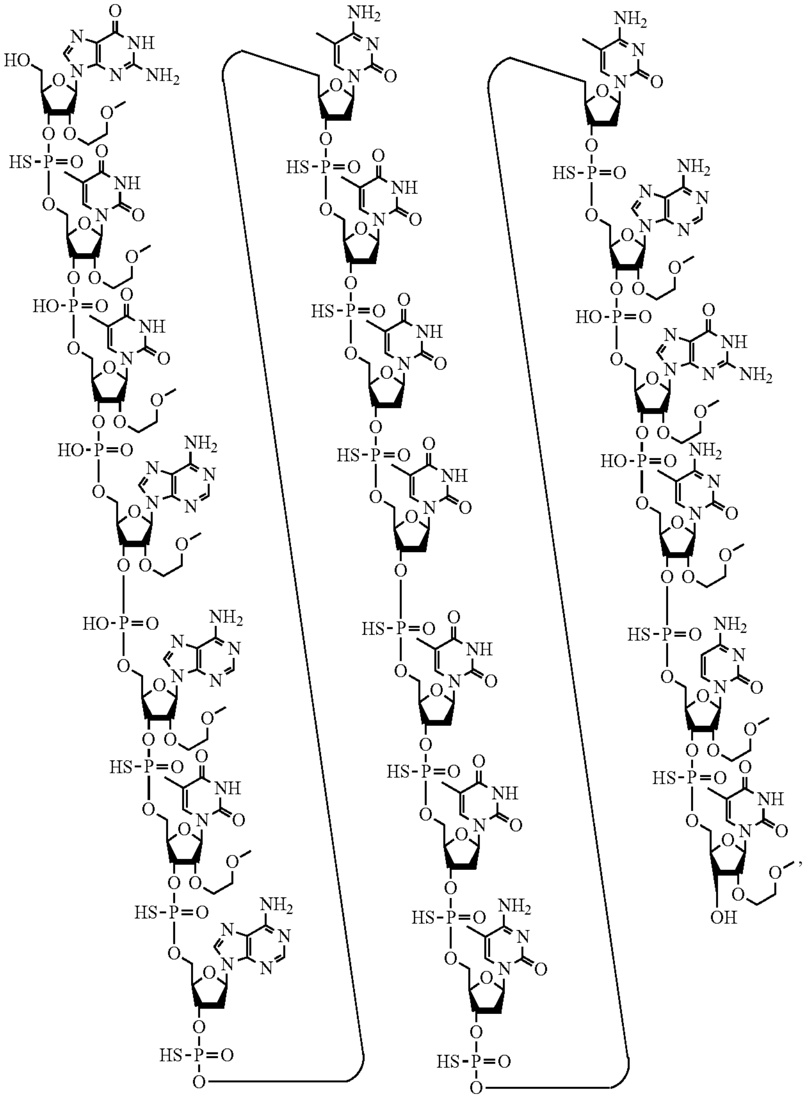
or a salt thereof.
Embodiment 53. A modified oligonucleotide according to the following chemical structure:

(SEQ ID NO: 2807)
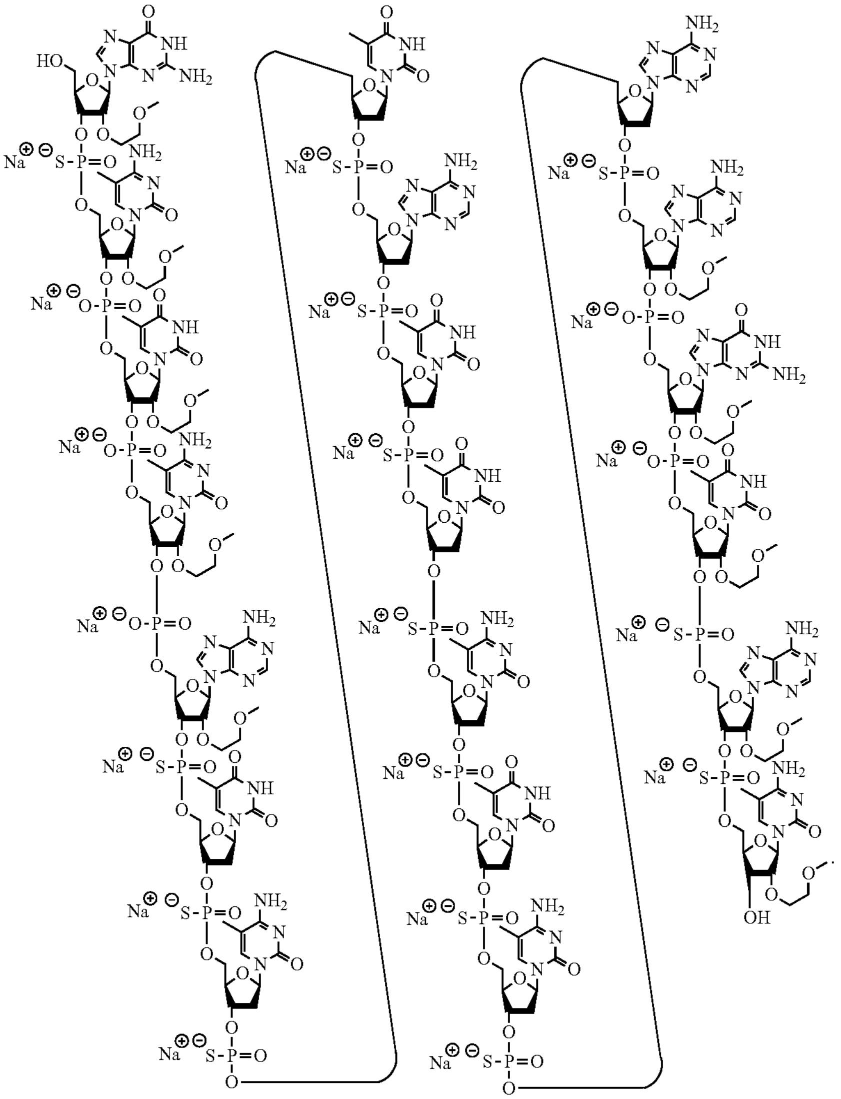

Embodiment 54. A modified oligonucleotide according to the following chemical structure:
(SEQ ID NO: 2808)
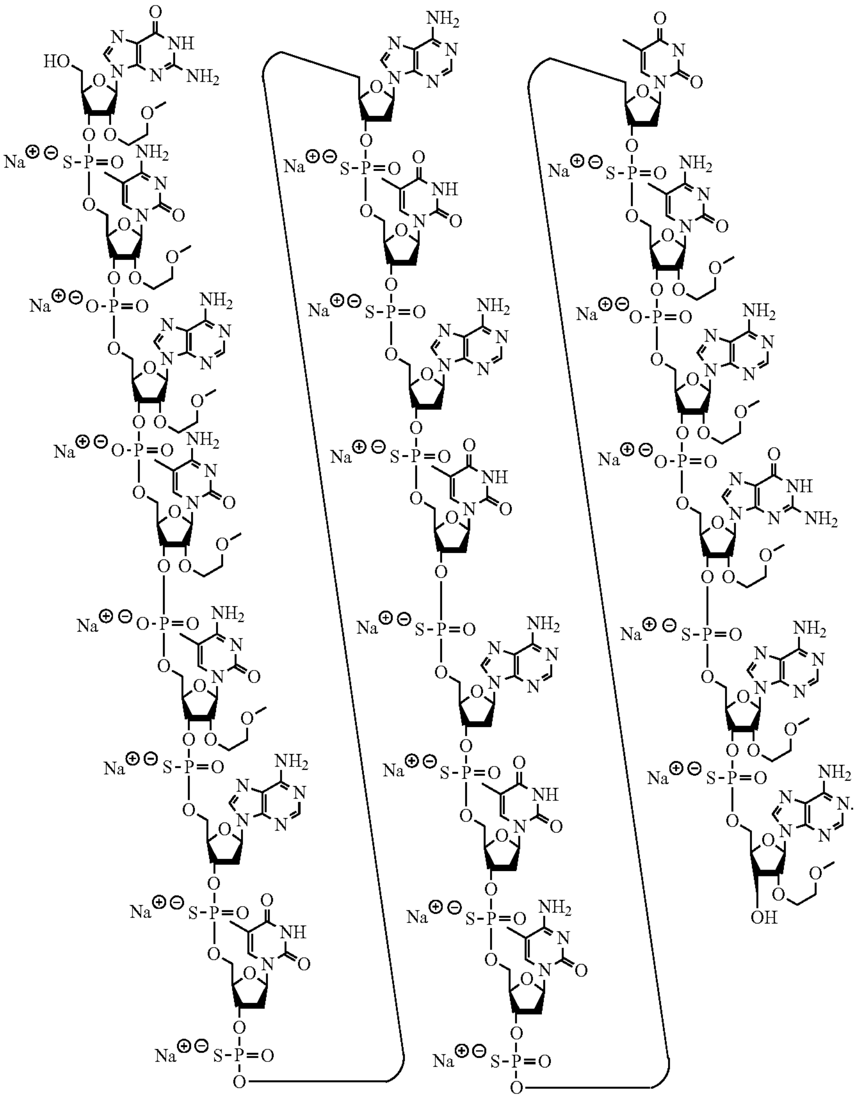

Embodiment 55. A modified oligonucleotide according to the following chemical structure:

(SEQ ID NO: 2809)

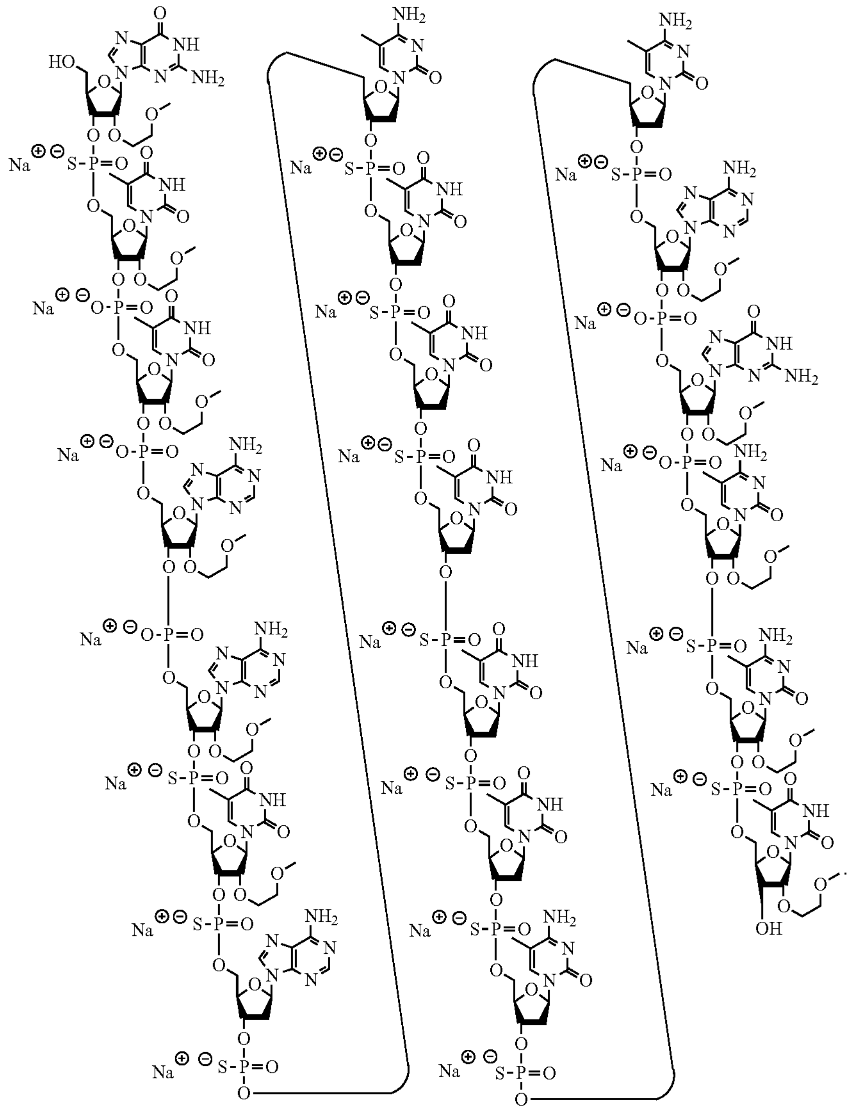

Embodiment 56. The modified oligonucleotide of any of embodiments 50, 52, or 54, which is a sodium salt of the formula.

Embodiment 57. A pharmaceutical composition comprising the modified oligonucleotide ofany of embodiments 50-56 and a pharmaceutically acceptable carrier or diluent.

Embodiment 58. The pharmaceutical composition of embodiment 57, wherein the pharmaceutically acceptable diluent is artificial cerebrospinal fluid.

Embodiment 59 The pharmaceutical composition of embodiment 57, wherein the pharmaceutical composition consists essentially of the modified oligonucleotide and artificial cerebrospinal fluid.

Embodiment 60. A compound comprising a modified oligonucleotide according to the following chemical notation (5' to 3'): Ges $^{m}$Ceo Teo $^{m}$Ceo Aes Tds Tds Tds Ads Tds Tds $^{m}$Cds Tds $^{m}$Cds Ads Aeo Geo Tes Aes $^{m}$Ce (SEQ ID NO: 2807), wherein, A=an adenine nucleobase, $^{m}$C=a 5-methyl cytosine, G=a guanine nucleobase, T=a thymine nucleobase, e=a 2' MOE sugar moiety, d=a 2'-β-D deoxyribosyl sugar moiety, s=a phosphorothioate internucleoside linkage, and o=a phosphodiester internucleoside linkage.

Embodiment 61. A compound comprising a modified oligonucleotide according to the following chemical notation (5' to 3'): Ges $^{m}$Ceo Aeo $^{m}$Ceo $^{m}$Ces Ads Tds Ads Tds Ads Tds Ads Tds $^{m}$Cds Tds $^{m}$Ceo Aeo Ges Aes Ae (SEQ ID NO: 2808), wherein, A=an adenine nucleobase, $^{m}$C=a 5-methyl cytosine, G=a guanine nucleobase, T=a thymine nucleobase, e=a 2' MOE sugar moiety, d=a 2'-β-D deoxyribosyl sugar moiety,
s=a phosphorothioate internucleoside linkage, and
o=a phosphodiester internucleoside linkage.

Embodiment 62. A compound comprising a modified oligonucleotide according to the following chemical notation (5' to 3'): Ges Teo Teo Aeo Aes Tds Ads $^{m}$Cds Tds Tds Tds Tds Tds $^{m}$Cds $^{m}$Cds Aeo Geo $^{m}$Ces $^{m}$Ces Te (SEQ ID NO: 2809), wherein, A=an adenine nucleobase,
mC=a 5-methyl cytosine,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 63. The compound of any of embodiments 60-62, comprising the modified oligonucleotide covalently linked to a conjugate group.

Embodiment 64. The compound of any of embodiment 1-63, wherein at least one internucleoside linkage of the modified oligonucleotide is chirally controlled.

Embodiment 65. The compound of any of embodiments 1-64, wherein at least one internucleoside linkage of the modified oligonucleotide is stereorandom.

Embodiment 66. A pharmaceutical composition comprising the compound of any of embodiments 60-65 and a pharmaceutically acceptable diluent or carrier.

Embodiment 67. The pharmaceutical composition of embodiment 66, wherein the pharmaceutically acceptable diluent is artificial cerebrospinal fluid.

Embodiment 68. The pharmaceutical composition of embodiment 66, wherein the pharmaceutical composition consists essentially of the modified oligonucleotide and artificial cerebrospinal fluid.

Embodiment 69. A chirally enriched population of modified oligonucleotides of any of embodiments 50-55, wherein the population is enriched for modified oligonucleotides comprising at least one particular phosphorothioate internucleoside linkage having a particular stereochemical configuration.

Embodiment 70. The chirally enriched population of embodiment 69, wherein the population is enriched for modified oligonucleotides comprising at least one particular phosphorothioate internucleoside linkage having the (Sp) configuration.

Embodiment 71. The chirally enriched population of embodiment 69, wherein the population is enriched for modified oligonucleotides comprising at least one particular phosphorothioate internucleoside linkage having the (Rp) configuration.

Embodiment 72. The chirally enriched population of embodiment 69, wherein the population is enriched for modified oligonucleotides having a particular, independently selected stereochemical configuration at each phosphorothioate internucleoside linkage Embodiment 73. The chirally enriched population of embodiment 73, wherein the population is enriched for modified oligonucleotides having the (Sp) configuration at each phosphorothioate internucleoside linkage.

Embodiment 74. The chirally enriched population of embodiment 73, wherein the population is enriched for modified oligonucleotides having the (Rp) configuration at each phosphorothioate internucleoside linkage.

Embodiment 75. The chirally enriched population of embodiment 73, wherein the population is enriched for modified oligonucleotides having the (Rp) configuration at one particular phosphorothioate internucleoside linkage and the (Sp) configuration at each of the remaining phosphorothioate internucleoside linkages.

Embodiment 76. The chirally enriched population of embodiment 69 or embodiment 73 wherein the population is enriched for modified oligonucleotides having at least 3 contiguous phosphorothioate internucleoside linkages in the Sp, Sp, and Rp configurations, in the 5' to 3' direction.

Embodiment 77. A chirally enriched population of modified oligonucleotides of any of embodiments 50-55, wherein all of the phosphorothioate internucleoside linkages of the modified oligonucleotide are stereorandom.

I. Certain Oligonucleotides

In certain embodiments, provided herein are oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-$OCH_3$ ("OMe" or "O-methyl"), and 2'-$O(CH_2)_2OCH_3$ ("MOE"). In certain embodiments, 2'-substituent groups are selected from among: halo, allyl, amino, azido, SH, CN, OCN, $CF_3$, $OCF_3$, O—$C_1$-$C_{10}$ alkoxy, O—$C_1$-$C_{10}$ substituted alkoxy, O—$C_1$-$C_{10}$ alkyl, O—$C_1$-$C_{10}$ substituted alkyl, S-alkyl, N($R_m$)-alkyl, O-alkenyl, S-alkenyl, N($R_m$)-alkenyl, O-alkynyl, S-alkynyl, N($R_m$)-alkynyl, O-alkylenyl-O-alkyl, alkynyl, alkaryl, aralkyl, O-alkaryl, O-aralkyl, $O(CH_2)_2SCH_3$, $O(CH_2)_2ON(R_m)(R_n)$ or $OCH_2C(=O)—N(R_m)(R_n)$, where each $R_m$ and $R_n$ is, independently, H, an amino protecting group, or substituted or unsubstituted $C_1$-$C_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, $NH_2$, $N_3$, $OCF_3$, $OCH_3$, $O(CH_2)_3NH_2$, $CH_2CH{=}CH_2$, $OCH_2CH{=}CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C({=}O){-}N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted nucleoside non-bicyclic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C({=}O){-}N(H)CH_3$ ("NMA").

In certain embodiments, a 2'-substituted non-bicyclic modified nucleoside comprises a sugar moiety comprising a non-bridging 2'-substituent group selected from: F, $OCH_3$, and $OCH_2CH_2OCH_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-$CH(CH_3)$—O-2' (referred to as "constrained ethyl" or "cEt"), 4'-$CH_2$—O—$CH_2$-2', 4'-$CH_2$—N(R)-2', 4'-CH($CH_2OCH_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g., Seth et al., U.S. Pat. No. 8,278,283), 4'-$CH_2$—N($OCH_3$)-2' and analogs thereof (see, e.g., Prakash et al., U.S. Pat. No. 8,278,425), 4'-$CH_2$—O—N($CH_3$)-2' (see, e.g., Allerson et al., U.S. Pat. No. 7,696,345 and Allerson et al., U.S. Pat. No. 8,124,745), 4'-$CH_2$—C(H)($CH_3$)-2' (see, e.g., Zhou, et al., *J. Org. Chem.,* 2009, 74, 118-134), 4'-$CH_2$—C(=$CH_2$)-2' and analogs thereof (see e.g., Seth et al., U.S. Pat. No. 8,278,426), 4'-$C(R_aR_b)$—N(R)—O-2', 4'-$C(R_aR_b)$—O—N(R)-2', 4'-$CH_2$—O—N(R)-2', and 4'-$CH_2$—N(R)—O- 2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —$[C(R_a)(R_b)]_n$—, —$[C(R_a)(R_b)]_n$O—, —$C(R_a){=}C(R_b)$—, —$C(R_a){=}N$—, —$C({=}NR_a)$—, —C(=O)—, —C(=S)—, —O—, —$Si(R_a)_2$—, —$S({=}O)_x$—, and —$N(R_a)$—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl ($S({=}O)_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., *Nucleic Acids Research,* 1997, 25(22), 4429-4443, Albaek et al., *J. Org. Chem.,* 2006, 71, 7731-7740, Singh et al., *Chem. Commun.,* 1998, 4, 455-456; Koshkin et al., *Tetrahedron,* 1998, 54, 3607-3630; Kumar et al., *Bioorg. Med. Chem. Lett.,* 1998, 8, 2219-2222; Singh et al., *J. Org. Chem.,* 1998, 63, 10035-10039; Srivastava et al., *J. Am. Chem. Soc.,* 20017, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

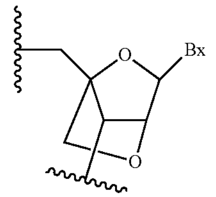

LNA (β-D-configuration)
bridge = 4'—$CH_2$—O—2'

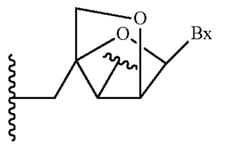

α-L-LNA (α-L-configuration)
bridge = 4'—$CH_2$—O—2'

α-L-methyleneoxy (4'-$CH_2$—O-2') or α-L-LNA bicyclic nucleosides have been incorporated into oligonucleotides that showed antisense activity (Frieden et al., *Nucleic Acids Research,* 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

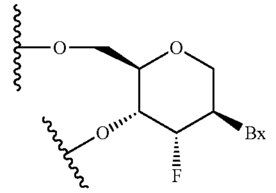

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005, 906; F-HNA can also be referred to as a F-THP or 3'-fluoro tetrahydropyran), and nucleosides comprising additional modified THP compounds having the formula:

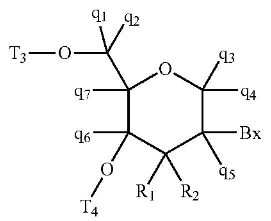

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $g_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

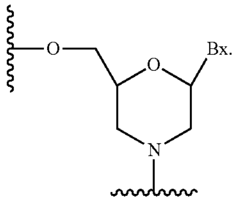

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.,* 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides).

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl ($-C \equiv C-CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS-P=S"). Representative non-phosphorus containing internucleoside linking groups include but are not limited to methylenemethylimino ($-CH_2-N(CH_3)-O-CH_2-$), thiodiester, thionocarbamate ($-O-C(=O)(NH)-S-$); siloxane ($-O-SiH_2-O-$); and N,N'-dimethylhydrazine ($-CH_2-N(CH_3)-N(CH_3)-$). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., JACS 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

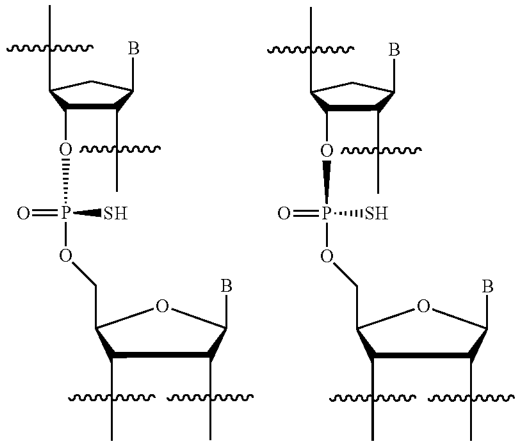

($R_p$) ($S_p$)

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—$N(CH_3)$—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl, and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, each nucleoside of each wing of a gapmer is a modified nucleoside. In certain embodiments, each nucleoside of each wing of a gapmer is a modified nucleoside. In certain embodiments, at least one nucleoside of each wing of a gapmer is a modified nucleoside. In certain embodiments, at least two nucleosides of each wing of a gapmer are modified nucleosides. In certain embodiments, at least three nucleosides of each wing of a gapmer are modified nucleosides. In certain embodiments, at least four nucleosides of each wing of a gapmer are modified nucleosides.

In certain embodiments, the gap of a gapmer comprises 7-12 nucleosides. In certain embodiments, each nucleoside of the gap of a gapmer is an unmodified 2'-deoxy nucleoside.

In certain embodiments, the gapmer is a deoxy gapmer. In embodiments, the nucleosides on the gap side of each wing/gap junction are unmodified 2'-deoxy nucleosides and the nucleosides on the wing sides of each wing/gap junction are modified nucleosides. In certain embodiments, each nucleoside of the gap is an unmodified 2'-deoxy nucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprise unmodified deoxynucleosides sugars. Thus, a 5-10-5 MOE gapmer consists of 5 linked MOE modified nucleosides in the 5'-wing, 10 linked deoxynucleosides in the gap, and 5 linked MOE nucleosides in the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P═O). In certain embodiments, each internucleoside linking group of a modified oligonucleotide is a phosphorothioate internucleoside linkage (P═S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides D. Certain Modified Oligonucleotides In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N. Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, 277, 923-937), a tocopherol group (Nishina et al., *Molecular Therapy Nucleic Acids,* 2015, 4, e220; and Nishina et al., *Molecular Therapy,* 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phophate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

V. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature RNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides that are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. ATXN3

In certain embodiments, oligomeric compounds comprise or consist of an oligonucleotide comprising a region that is complementary to a target nucleic acid, wherein the target nucleic acid is ATXN3. In certain embodiments, ATXN3 nucleic acid has the sequence set forth in SEQ ID NO: 1 (GENBANK Accession No: NM_004993.5); SEQ ID NO: 2 (the complement of GENBANK Accession No NC_000014.9 truncated from nucleotides 92,056,001 to 92,110,000); SEQ ID NO: 3 (GENBANK Accession No: NM_001164781.1); SEQ ID NO: 4 (GENBANK Accession No: NM_001127697.2); and SEQ ID NO: 5 (ensemble transcript No: ENST00000558190.5).

In certain embodiments, contacting a cell with an oligomeric compound complementary to any of SEQ ID NOs: 1-5 reduces the amount of ATXN3 RNA, and in certain embodiments reduces the amount of Ataxin-3 protein. In certain embodiments, the oligomeric compound consists of a modified oligonucleotide. In certain embodiments, contacting a cell in an animal with an oligomeric compound complementary to any of SEQ ID NOs: 1-5 ameliorate one or more symptom or hallmark of a neurodegenerative disease. In certain embodiments, the symptom or hallmark is ataxia, neuropathy, and aggregate formation. In certain embodiments, contacting a cell in an animal with an oligonucleotide complementary to any of SEQ ID Nos: 1-5 results in improved motor function, reduced neuropathy, and/or reduction in number of aggregates. In certain embodiments, the oligomeric compound consists of a modified oligonucleotide.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS), including spinal cord, cortex, cerebellum, brain stem, and pons.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain.

Under certain conditions, certain compounds disclosed herein act as acids. Although such compounds may be drawn or described in protonated (free acid) form, in ionized (anion) form, or ionized and in association with a cation (salt) form, aqueous solutions of such compounds exist in equilibrium among such forms. For example, a phosphate linkage of an oligonucleotide in aqueous solution exists in equilibrium among free acid, anion, and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salts thereof" expressly includes all such forms that may be fully or partially protonated/de-protonated/in association with a cation. In certain instances, one or more specific cation is identified.

In certain embodiments, modified oligonucleotides are in aqueous solution with sodium. In certain embodiments, modified oligonucleotides are in aqueous solution with potassium. In certain embodiments, modified oligonucleotides are in PBS. In certain embodiments, modified oligonucleotides are in water. In certain such embodiments, the pH of the solution is adjusted with NaOH and/or HCl to achieve a desired pH.

VI. Certain Compositions

1. Compound No. 1100673

In certain embodiments, Compound No. 1100673 is characterized as a 5-10-5 MOE gapmer having a sequence of (from 5' to 3') GCTCATTTATTCTCAAGTAC (SEQ ID NO: 423), wherein each of nucleosides 1-5 and 16-20 (from 5' to 3') comprise a 2'-MOE sugar moiety and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1100673 is represented by the following chemical notation (5' to 3'): Ges $^{m}$Ceo Teo $^{m}$Ceo Aes Tds Tds Tds Ads Tds Tds $^{m}$Cds Tds $^{m}$Cds Ads Aeo Geo Tes Aes $^{m}$Ce (SEQ ID NO: 2807), wherein, A=an adenine nucleobase, $^{m}$C=a 5-methyl cytosine, G=a guanine nucleobase, T=a thymine nucleobase, e=a 2' MOE sugar moiety, d=a 2'-β-D deoxyribosyl sugar moiety, s=a phosphorothioate internucleoside linkage, and o=a phosphodiester internucleoside linkage.

In certain embodiments, Compound No. 1100673 is represented by the following chemical structure:
Structure 1. Compound No. 1100673
(SEQ ID NO: 2807)
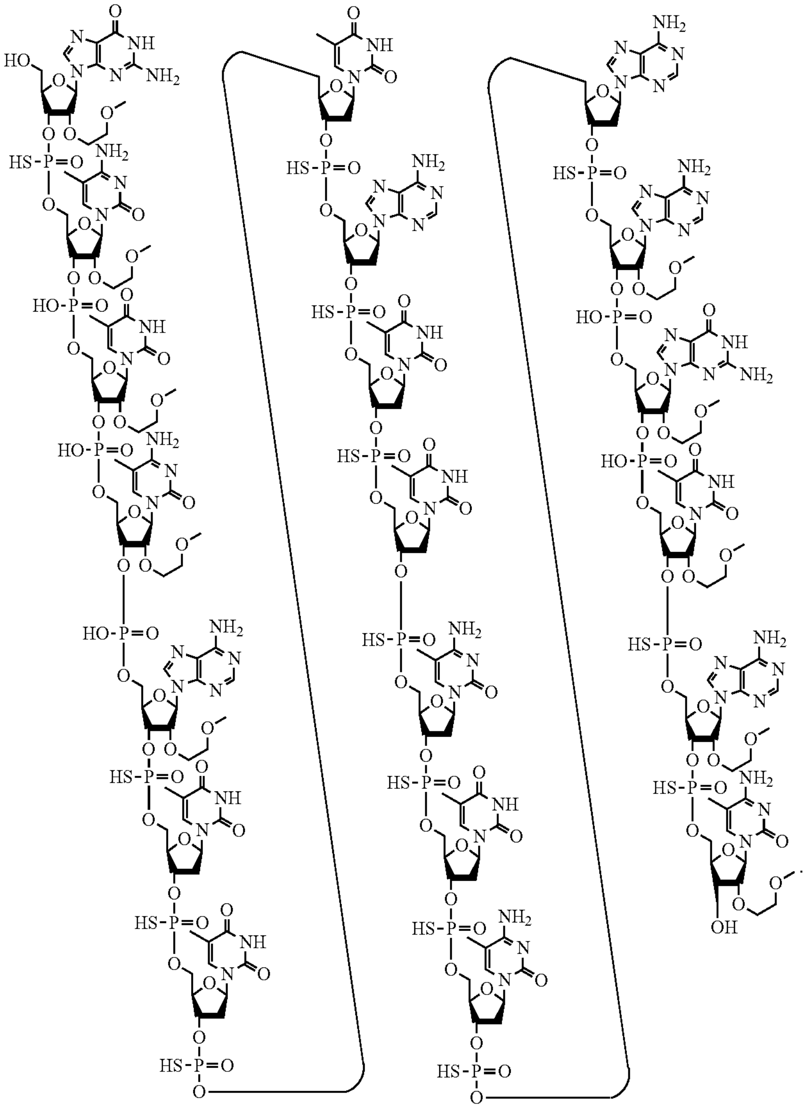

In certain embodiments, the sodium salt of Compound No. 1100673 is represented by the following chemical structure:

Structure 2. The sodium salt of Compound No. 1100673

(SEQ ID NO: 2807)

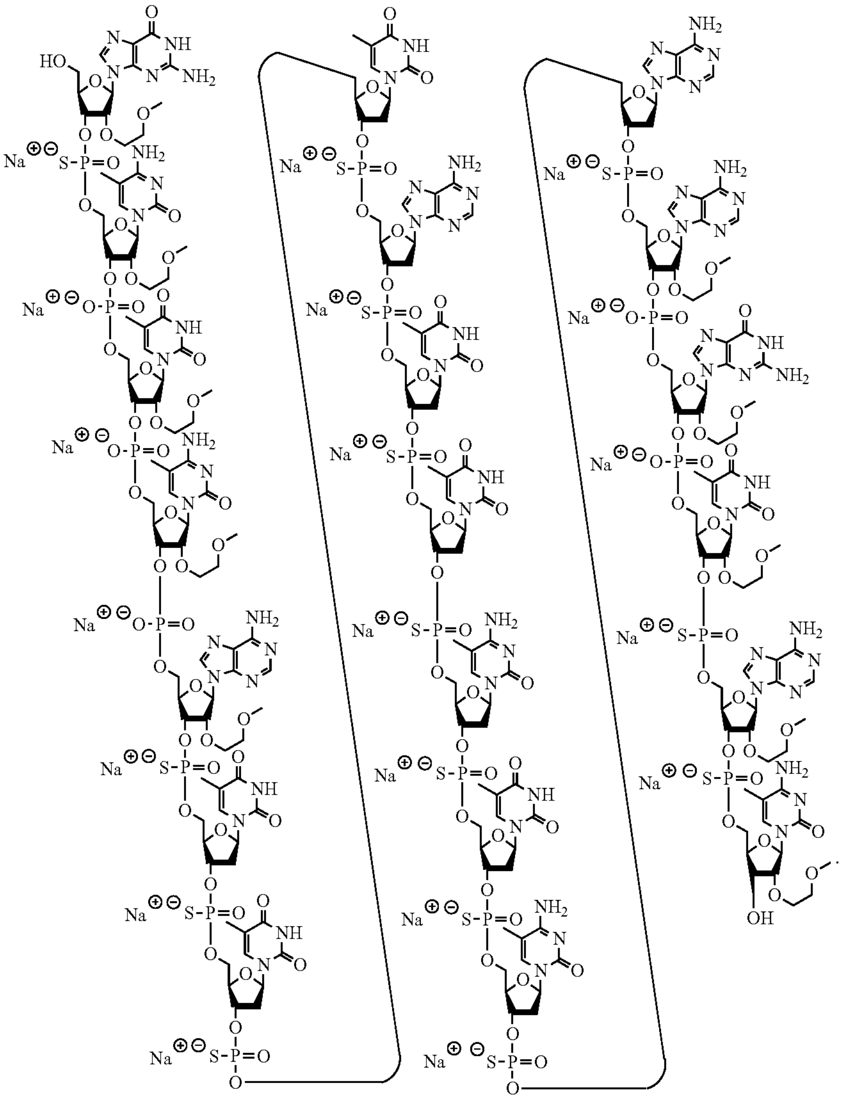

2. Compound No. 1101657

In certain embodiments, Compound No. 1101657 is characterized as a 5-10-5 MOE gapmer having a sequence of (from 5' to 3') GCACCATATATATCTCAGAA (SEQ ID NO: 1226), wherein each of nucleosides 1-5 and 16-20 (from 5' to 3') comprise a 2'-MOE sugar moiety and each of nucleosides 6-15 are 2'-β-D-deoxynucleosides (from 5' to 3'), wherein the internucleoside linkages between nucleosides 2 to 3, 3 to 4, 4 to 5, 16 to 17, and 17 to 18 are phosphodiester internucleoside linkages (from 5' to 3') and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages (from 5' to 3'), and wherein each cytosine is a 5-methyl cytosine.

In certain embodiments, Compound No. 1101657 is represented by the following chemical notation (5' to 3'): Ges $^{m}$Ceo Aeo $^{m}$Ceo $^{m}$Ces Ads Tds Ads Tds Ads Tds Ads Tds $^{m}$Cds Tds $^{m}$Ceo Aeo Ges Aes Ae (SEQ ID NO: 2808), wherein, A=an adenine nucleobase, $^{m}$C=a 5-methyl cytosine, G=a guanine nucleobase, T=a thymine nucleobase, e=a 2' MOE sugar moiety, d=a 2'-β-D deoxyribosyl sugar moiety, s=a phosphorothioate internucleoside linkage, and o=a phosphodiester internucleoside linkage.

In certain embodiments, Compound No. 1101657 is represented by the following chemical structure:
Structure 3. Compound No.1101657
(SEQ ID NO: 2808)
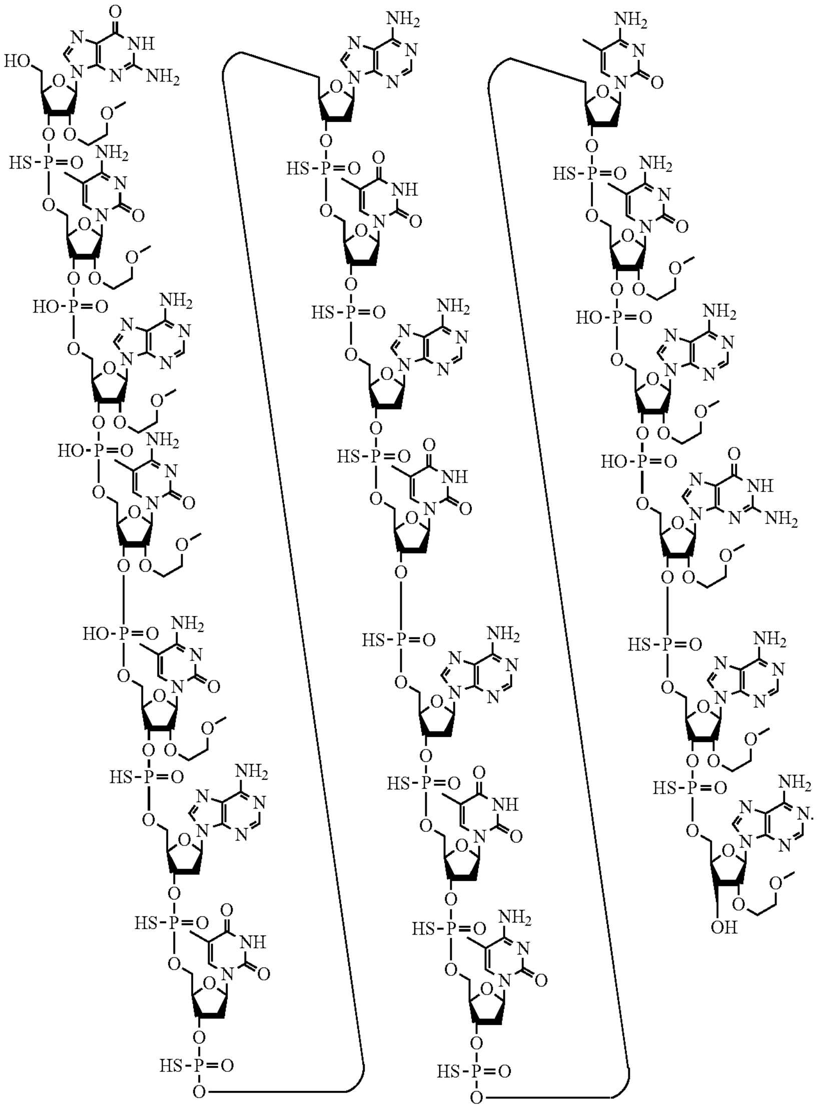

In certain embodiments, the sodium salt of Compound No. 1101657 is represented by the following chemical structure:

Structure 4. The sodium salt of Compound No. 1101657

(SEQ ID NO: 2808)

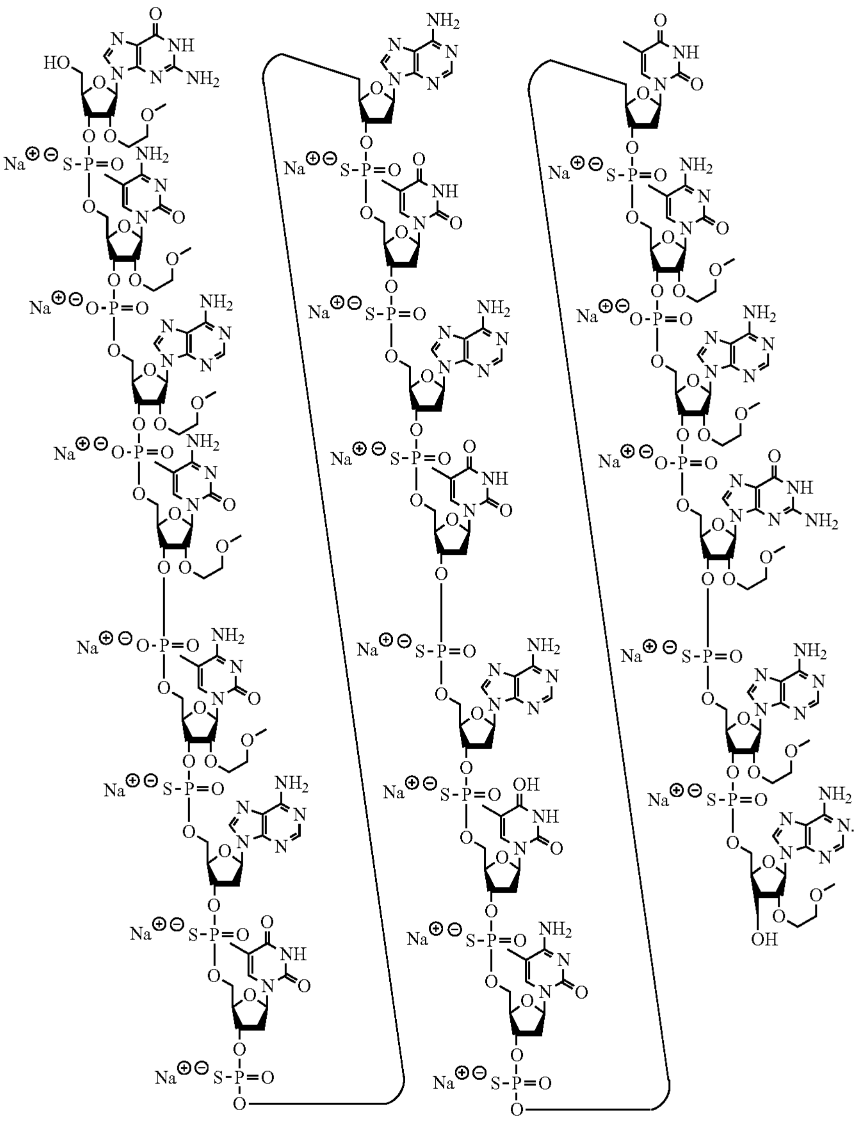

3. Compound No. 1102130

In certain embodiments, Compound No. 1102130 is characterized as a 5-10-5 MOE gapmer having a sequence of (from 5' to 3') GTTAATACTTTTTCCAGCCT (SEQ ID NO: 1673), wherein each of nucleosides 1-5 and 16-20 (from 5' to 3') comprise a 2'-MOE sugar moiety and each of nucleosides 6-15 are 2'-β-D-deoxynucleosides (from 5' to 3'), wherein the internucleoside linkages between nucleosides 2 to 3, 3 to 4, 4 to 5, 16 to 17, and 17 to 18 are phosphodiester internucleoside linkages (from 5' to 3') and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages (from 5' to 3'), and wherein each cytosine is a 5-methyl cytosine.

In certain embodiments, Compound No. 1102130 is represented by the following chemical notation (5' to 3'): Ges Teo Teo Aeo Aes Tds Ads $^{m}$Cds Tds Tds Tds Tds Tds $^{m}$Cds $^{m}$Cds Aeo Geo $^{m}$Ces $^{m}$Ces Te (SEQ ID NO: 2809), wherein, A=an adenine nucleobase, $^{m}$C=a 5-methyl cytosine, G=a guanine nucleobase, T=a thymine nucleobase, e=a 2' MOE sugar moiety, d=a 2'-β-D deoxyribosyl sugar moiety, s=a phosphorothioate internucleoside linkage, and o=a phosphodiester internucleoside linkage.

In certain embodiments, Compound No. 1102130 is represented by the following chemical structure:
Structure 5. Compound No. 1102130
(SEQ ID NO: 2809)
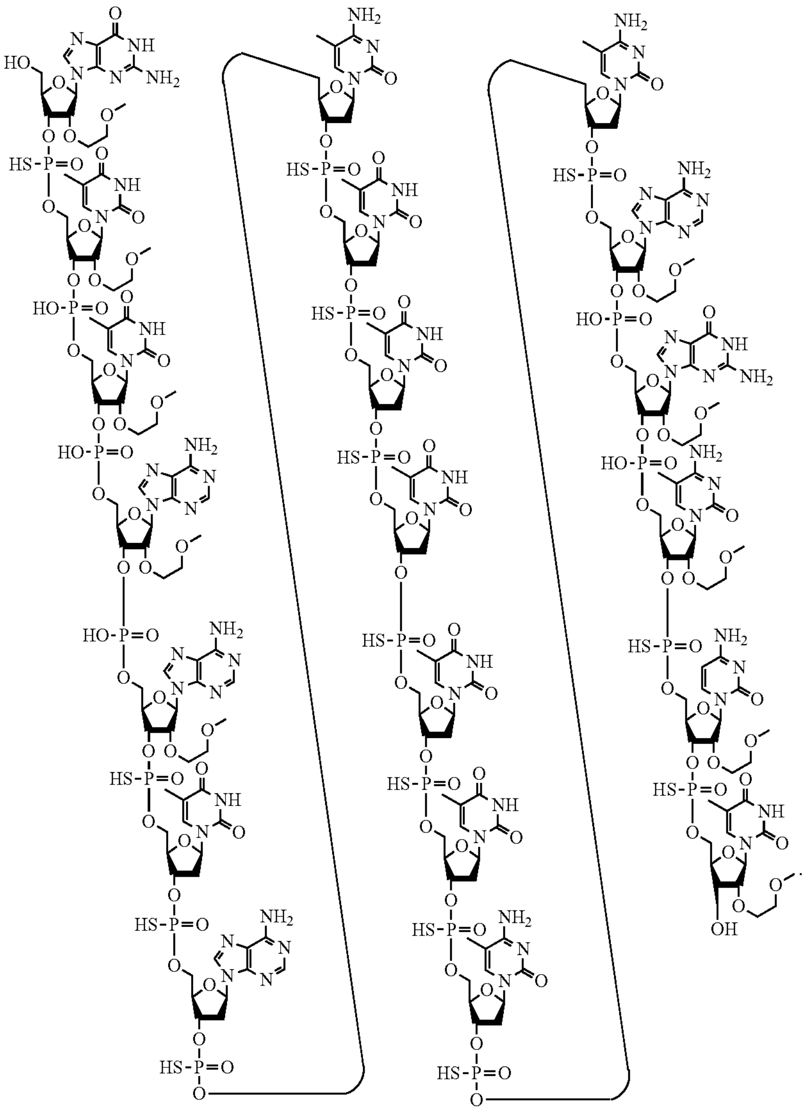

In certain embodiments, the sodium salt of Compound No. 1102130 is represented by the following chemical structure:

Structure 6. The sodium salt of compound No. 1102130

(SEQ ID NO: 2809)

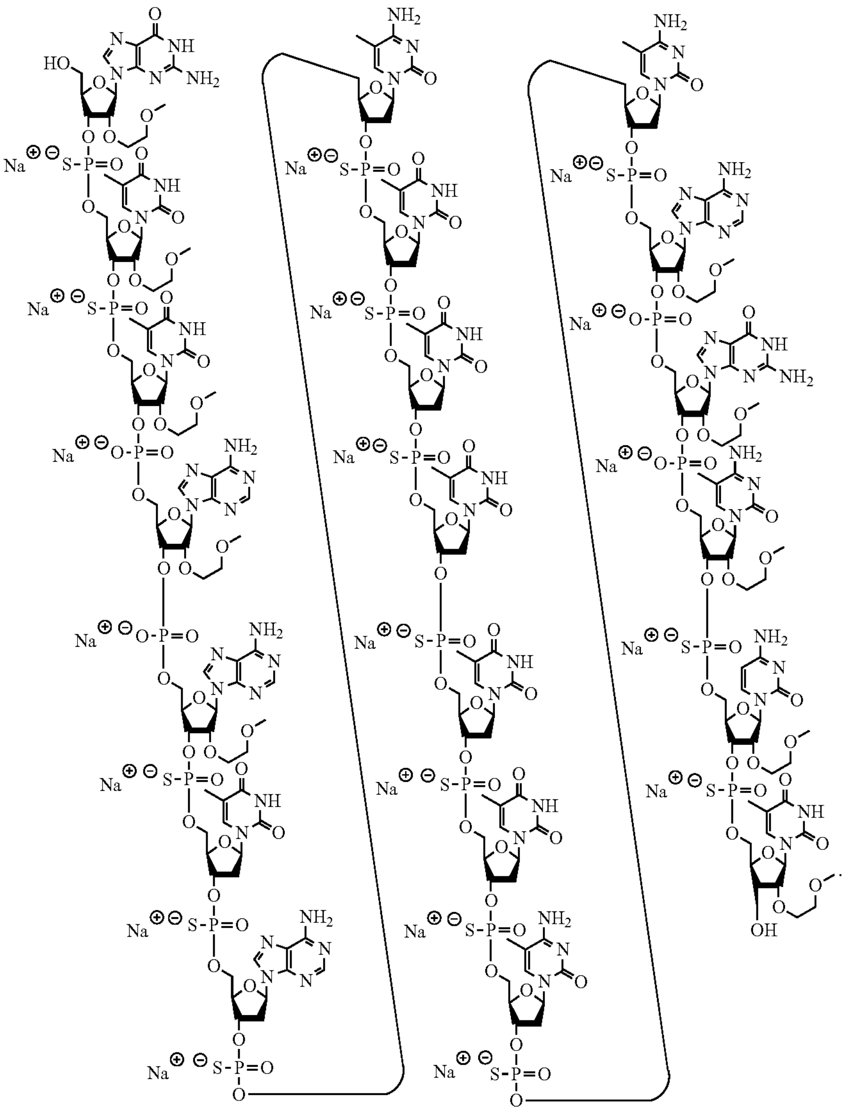

VIII. Certain Comparator Compositions

In certain embodiments, Compound No. 650528, which has been described in Moore, et al., Mol. Ther. Nucleic Acids, 2017, 7:200-210 (Moore, 2017) ("ASO-5"), WO 2018/089805, and McLoughlin et al., Ann. Neurol., 2018, 84:64-77 (McLoughlin, 2018) (each of which are incorporated herein by reference) was used as a comparator compound. Compound No. 650528 is a 5-8-5 MOE gapmer, having a sequence (from 5' to 3') GCATCTTTTCATACTGGC (SEQ ID NO: 2788), wherein each cytosine is a 5-methylcytosine, each internucleoside linkage is either a phosphodiester internucleoside linkage or a phosphorothioate internucleoside linkage and the internucleoside linkage motif is sooosssssssssooss, wherein 's' represents a phosphorothioate internucleoside linkage and 'o' represents a phosphodiester internucleoside linkage, and wherein each of nucleosides 1-5 and 14-18 comprise a 2'-MOE sugar moiety.

In certain embodiments, Compound No. 650668, which has been described in Moore, 2017 ("ASO-2"), WO 2018/089805, and McLoughlin, 2018 was used as a comparator compound. Compound No. 650668, is a 5-8-5 MOE gapmer, having a sequence (from 5' to 3') AGCCATTAATCTATACTG (SEQ ID NO: 2792), wherein each cytosine is a 5-methylcytosine, each internucleoside linkage is either a phosphodiester internucleoside linkage or a phosphorothioate internucleoside linkage and the internucleoside linkage motif is sooosssssssssooss, wherein 's' represents a phosphorothioate internucleoside linkage and 'o' represents a phosphodiester internucleoside linkage, and wherein each of nucleosides 1-5 and 14-18 comprise a 2'-MOE sugar moiety.

Compound No. 650528 and Compound No. 650668 were selected as comparator compounds because according to Moore, 2017 these compounds were "top ASO candidates" that were effective and tolerable. See, e.g., page 206, column 2, paragraph 1. In a follow up manuscript, Compound No. 650528 was further characterized as " . . . the best ASO candidate . . . [f]rom this short-term safety and efficacy study . . . " See, McLoughlin, 2018.

In certain embodiments, Compound No. 1244463 ("SH06"), which has been described in WO2013/138353 (incorporated by reference) is a comparator compound. Compound No. 1244463 is a 3-9-3 LNA gapmer, having a sequence (from 5' to 3') ATAGGTCCCGCTGCT (SEQ ID NO: 2793), and wherein each internucleoside linkage is a phosphorothioate internucleoside linkage.

In certain embodiments, Compound No. 1244464 ("SH10"), which has been described in WO2013/138353 is a comparator compound. Compound No. 1244464 is a 3-10-3 LNA gapmer, having a sequence (from 5' to 3') TGATAGGTCCCGCTGC (SEQ ID NO: 2794), and wherein each internucleoside linkage is a phosphorothioate internucleoside linkage.

In certain embodiments, Compound No. 1244465 ("SH13"), which has been described in WO2013/138353 is a comparator compound. Compound No. 1244465 is a 3-10-3 LNA gapmer, having a sequence (from 5' to 3') CTGATAGGTCCCGCTG (SEQ ID NO: 2795), and wherein each internucleoside linkage is a phosphorothioate internucleoside linkage.

In certain embodiments, Compound No. 1244466 ("SH16"), which has been described in WO2013/138353 is a comparator compound. Compound No. 1244466 is a 3-9-3 LNA gapmer, having a sequence (from 5' to 3') CTGATAGGTCCCGCT (SEQ ID NO: 2796), and wherein each internucleoside linkage is a phosphorothioate internucleoside linkage.

In certain embodiments, Compound No. 1244467 ("SH20"), which has been described in WO2013/138353 is a comparator compound. Compound No. 1244467 is a 2-9-3 LNA gapmer, having a sequence (from 5' to 3') CTGATAGGTCCCGC (SEQ ID NO: 2797), and wherein each internucleoside linkage is a phosphorothioate internucleoside linkage.

Compound No. 1244463, Compound No. 1244464, Compound No. 1244465, Compound No. 1244466, and Compound No. 1244467 were selected as comparator compounds because according to Example 2 of WO2013/138353 these compounds were selected for further study. Accordingly, these compounds were tested in further studies.

In certain embodiments, compounds described herein are superior relative to compounds described in Moore, 2017, WO 2018/089805, and WO2013/138353 because they demonstrate one or more improved properties, such as, potency and tolerability.

For example, as described herein, certain compounds Compound No. 1100673, Compound No. 1101657, and Compound No. 1102130 achieved an $IC_{50}$ in Example 7, hereinbelow, of 0.10 μM, 0.69 μM, and 0.47 μM, respectively, whereas comparator compound, Compound No. 650528 ("ASO-5") achieved an $IC_{50}$ in Example 7, hereinbelow, of 2.03 μM and Compound No. 650668 ("ASO-2") achieved an $IC_{50}$ in Example 2 of WO 2018/089805 of 1.7 μM. Therefore, certain compounds described herein are more potent than comparator compounds, Compound No. 650528 ("ASO-5") and Compound No. 650668 ("ASO-2") in this assay.

For example, as described herein, certain compounds Compound No. 1100673, Compound No. 1101657, and Compound No. 1102130 are more efficacious and potent than comparator compounds in vivo. See, e.g., Examples 4, 6, and 9, hereinbelow. For example, as provided in Examples 4 and 6, certain compounds Compound No. 1100673, Compound No. 1101657, and Compound No. 1102130 achieved an average expression level (% control) of 13%, 23%, and 27%, respectively, in spinal cord of transgenic mice whereas comparator compound, Compound No. 650528 ("ASO-5") achieved an average expression level (% control) of 32% in spinal cord of transgenic mice. For example, as provided in Examples 4 and 6, certain compounds Compound No. 1100673, Compound No. 1101657, and Compound No. 1102130 achieved an average expression level (% control) of 13%, 23%, and 42%, respectively, in cortex of transgenic mice whereas comparator compound, Compound No. 650528 ("ASO-5") achieved an average expression level (% control) of 43% in cortex of transgenic mice. For example, as provided in Examples 4 and 6, certain compounds Compound No. 1100673, Compound No. 1101657, and Compound No. 1102130 achieved an average expression level (% control) of 60%, 62%, and 68%, respectively, in cerebellum of transgenic mice whereas comparator compound, Compound No. 650528 ("ASO-5") achieved an average expression level (% control) of 75% in cerebellum of transgenic mice. For example, as provided in Examples 4 and 6, certain compounds Compound No. 1100673, Compound No. 1101657, and Compound No. 1102130 achieved an average expression level (% control) of 14%, 26%, and 23%, respectively, in brain stem of transgenic mice whereas comparator compound, Compound No. 650528 ("ASO-5") achieved an average expression level (% control) of 35% in brain stem of transgenic mice. Therefore, certain compounds described herein are more efficacious than comparator compound, Compound No. 650528 ("ASO-5") in this assay. Specifically, certain compounds Compound No. 1100673, Compound No. 1101657, and Compound No. 1102130 are more efficacious than Compound No. 650528 ("ASO-5") in every tissue tested in this assay.

For example, as described herein, certain compounds Compound No. 1100673, Compound No. 1101657, and Compound No. 1102130 achieved 3-hour FOB scores in mice of 1.00 (table 9) and 0.00 (table 20), 1.00 (table 9) and 0.00 (table 20), and 0.00 (table 8 and table 20), respectively, whereas each of comparator compounds Compound No. 1244463, Compound No. 1244464, Compound No. 1244465, Compound No. 1244466, and Compound No. 1244447 achieved 3-hour FOB scores in mice of 7.00 (table 26). Therefore, certain compounds described herein are more tolerable than comparator compounds Compound No. 1244463, Compound No. 1244464, Compound No. 1244465, Compound No. 1244466, and Compound No. 1244447 in this assay.

IX. Certain Hotspot Regions

1. Nucleobases 138-175 of SEQ ID NO: 1

In certain embodiments, nucleobases 138-175 of SEQ ID NO: 1 comprise a hotspot region. In certain embodiments, modified oligonucleotides are complementary to nucleobases 138-175 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages.

The nucleobase sequences of SEQ ID Nos: 1060, 1061, 1062, 1063, 1064, and 1065 are complementary to nucleobases 138-175 of SEQ ID NO: 1.

In certain embodiments, modified oligonucleotides complementary to nucleobases 138-175 of SEQ ID NO: 1 achieve at least 79% reduction of ATXN3 RNA in vitro in the standard cell assay.

2. Nucleobases 392-436 of SEQ ID NO: 1

In certain embodiments, nucleobases 392-436 of SEQ ID NO: 1 comprise a hotspot region. In certain embodiments, modified oligonucleotides are complementary to nucleobases 392-436 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 196, 197, 198,199, 200, 201, 202, 203, 204, 205, 206, 207, 208, 209 are complementary to nucleobases 392-436 of SEQ ID NO 1.

In certain embodiments, modified oligonucleotides complementary to nucleobases 392-436 of SEQ ID NO: 1 achieve an average of 77% reduction of ATXN3 RNA in vitro in the standard cell assay.

3. Nucleobases 1120-1146 of SEQ ID NO: 1

In certain embodiments, nucleobases 1120-1146 of SEQ ID NO: 1 comprise a hotspot region. In certain embodiments, modified oligonucleotides are complementary to nucleobases 1120-1146 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 313, 314, 315, 316, and 317 are complementary to nucleobases 1120-1146 of SEQ ID NO: 1.

In certain embodiments, modified oligonucleotides complementary to nucleobases 1120-1146 of SEQ ID NO: 1 achieve at least 60% reduction of ATXN3 RNA in vitro in the standard cell assay.

4. Nucleobases 1823-1882 of SEQ ID NO:1

In certain embodiments, nucleobases 1823-1882 of SEQ ID NO: 1 comprise a hotspot region. In certain embodiments, modified oligonucleotides are complementary to nucleobases 1823-1882 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 413-423 are complementary to nucleobases 1823-1882 of SEQ ID NO: 1.

In certain embodiments, modified oligonucleotides complementary to nucleobases 1823-1882 of SEQ ID NO: 1 achieve at least 60% reduction of ATXN3 RNA in vitro in the standard cell assay.

5. Nucleobases 3042-3098 of SEQ ID NO: 1

In certain embodiments, nucleobases 3042-3098 of SEQ ID NO: 1 comprise a hotspot region. In certain embodiments, modified oligonucleotides are complementary to nucleobases 3042-3098 of SEQ ID NO: 1. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos:43, 44, 45, and 635-653 are complementary to nucleobases 3042-3098 of SEQ ID NO: 1.

In certain embodiments, modified oligonucleotides complementary to nucleobases 3042-3098 of SEQ ID NO: 1 achieve at least 64% reduction of ATXN3 RNA in vitro in the standard cell assay.

6. Nucleobases 3749-3801 of SEQ ID NO: 1

In certain embodiments, nucleobases 3749-3801 of SEQ ID NO: 1 comprise a hotspot region. In certain embodiments, modified oligonucleotides are complementary to nucleobases 3749-3801 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 719-732 are complementary to nucleobases 3749-3801 of SEQ ID NO: 1.

In certain embodiments, modified oligonucleotides complementary to nucleobases 3749-3801 of SEQ ID NO: 1 achieve at least 52% reduction of ATXN3 RNA in vitro in the standard cell assay.

7. Nucleobases 5997-6021 of SEQ ID NO: 1

In certain embodiments, nucleobases 5997-6021 of SEQ ID NO: 1 comprise a hotspot region. In certain embodiments, modified oligonucleotides are complementary to nucleobases 5997-6021 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 920-924 are complementary to nucleobases 5997-6021 of SEQ ID NO: 1.

In certain embodiments, modified oligonucleotides complementary to nucleobases 5997-6021 of SEQ ID NO: 2 achieve at least 75% reduction of ATXN3 RNA in vitro in the standard cell assay.

8. Nucleobases 19437-19476 of SEQ ID NO: 2

In certain embodiments, nucleobases 19437-19476 of SEQ ID NO: 2 comprise a hotspot region. In certain embodiments, modified oligonucleotides are complementary to nucleobases 19437-19476 of SEQ ID NO: 2. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos: 1671, 1672, 1673, and 1674 are complementary to nucleobases 19437-19476 of SEQ ID NO: 2.

In certain embodiments, modified oligonucleotides complementary to nucleobases 19437-19476 of SEQ ID NO: 2 achieve at least 83% reduction of ATXN3 RNA in vitro in the standard cell assay.

9. Nucleobases 34440-34486 of SEQ ID NO: 2

In certain embodiments, nucleobases 34440-34486 of SEQ ID NO: 2 comprise a hotspot region. In certain embodiments, modified oligonucleotides are complementary to nucleobases 34440-34486 of SEQ ID NO: 2. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 2233, 2234, 2235, 2236, and 2237 are complementary to nucleobases 34440-34486 of SEQ ID NO: 2.

In certain embodiments, modified oligonucleotides complementary to nucleobases 34440-34486 of SEQ ID NO: 2 achieve at least 71% reduction of ATXN3 RNA in vitro in the standard cell assay.

10. Nucleobases 39883-39904 of SEQ ID NO: 2

In certain embodiments, nucleobases 39883-39904 of SEQ ID NO: 2 comprise a hotspot region. In certain embodiments, modified oligonucleotides are complementary to nucleobases 39860-39904 of SEQ ID NO: 2. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos: 2510, 2511, and 2512 are complementary to nucleobases 39883-39904 of SEQ ID NO: 2.

In certain embodiments, modified oligonucleotides complementary to nucleobases 39883-39904 of SEQ ID NO: 2 achieve at least 89% reduction of ATXN3 RNA in vitro in the standard cell assay.

11. Nucleobases 6597-6618 of SEQ ID NO: 2

In certain embodiments, nucleobases 6597-6618 of SEQ ID NO: 2 comprise a hotspot region. In certain embodiments, modified oligonucleotides are complementary to nucleobases 6597-6618 of SEQ ID NO: 2. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos: 1226, 1227, and 1228 are complementary to nucleobases 6597-6618 of SEQ ID NO: 2.

In certain embodiments, modified oligonucleotides complementary to nucleobases 6597-6618 of SEQ ID NO: 2 achieve at least 75% reduction of ATXN3 RNA in vitro in the standard cell assay.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^{m}$CGAUCG," wherein $^{m}$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^{1}$H hydrogen atoms. Isotopic substitutions encompassed by the compounds herein include but are not limited to: $^{2}$H or $^{3}$H in place of $^{1}$H, $^{13}$C or $^{14}$C in place of $^{12}$C, $^{15}$N in place of $^{14}$N, $^{17}$O or $^{18}$O in place of $^{16}$O and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 5-10-5 MOE Gapmers with Mixed Internucleoside Linkages on Human ATXN3 In Vitro, Single Dose Modified oligonucleotides complementary to a human ATXN3 nucleic acid were designed and tested for their effect on ATXN3 RNA in vitro. The modified oligonucleotides were tested in a series of experiments that had similar culture conditions.

Cultured A431 cells at a density of 10,000 cells per well were transfected by free uptake with 4,000 nM concentration of modified oligonucleotide or no modified oligonucleotide for untreated controls. After approximately 24 hours, RNA was isolated from the cells and ATXN3 RNA levels were measured by quantitative real-time PCR. Human primer probe set RTS38920 (forward sequence CTATCAGGACAGAGTTCACATCC, designated herein as SEQ ID NO: 6; reverse sequence GTTTCTAAAGACATGGTCACAGC, designated herein as SEQ ID NO: 7; probe sequence AAAGGCCAGCCACCAGTTCAGG, designated herein as SEQ ID: 8) was used to measure RNA levels. ATXN3 RNA levels were adjusted according to total RNA content, as measured by RiboGreen®. Results are presented in the table below as percent ATXN3 RNA levels relative to untreated control cells. The modified oligonucleotides marked with an asterisk (*) target the amplicon region of the primer probe set. Additional assays may be used to measure the potency and efficacy of oligonucleotides targeting the amplicon region.

The modified oligonucleotides in the tables below are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides each. The sugar motif for the gapmers is (from 5' to 3'): eeeeeddddddddddeeeee; wherein 'd' represents a 2'-deoxyribose sugar and 'e' represents a 2'-MOE modified sugar. All cytosine residues throughout each gapmer are 5-methyl cytosines. The internucleoside linkages are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the tables below is complementary to human ATXN3 nucleic acid sequences SEQ ID No: 1, SEQ ID No: 2, SEQ ID No: 3, SEQ ID No: 4, or SEQ ID No: 5, as indicated. 'N/A' indicates that the modified oligonucleotide is not complementary to that particular nucleic acid sequence with 100% complementarity. As shown below, modified oligonucleotides complementary to human ATXN3 reduced the amount of human ATXN3 RNA.

TABLE 1

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1100357 | 15 | 34 | 3394 | 3413 | ACCACCCCCTCCAGCTCCGC | 88 | 15 |
| 1100359 | 17 | 36 | 3396 | 3415 | GAACCACCCCCTCCAGCTCC | 83 | 16 |
| 1100393 | 383 | 402 | N/A | N/A | TGATCTTTCATTTATAGGAT | 86 | 17 |
| 1100395 | 385 | 404 | N/A | N/A | AATGATCTTTCATTTATAGG | 74 | 18 |
| 1100429 | 458 | 477 | 21185 | 21204 | GAGAGAATTCAAGTTAAACC | 25 | 19 |
| 1100431 | 470 | 489 | 21197 | 21216 | TGGACCCGTCAAGAGAGAAT | 35 | 20 |
| 1100465 | 638 | 657 | 26836 | 26855 | TAATTCTTCTCCAATAAGTT | 101 | 21 |
| 1100467 | 641 | 660 | 26839 | 26858 | TGCTAATTCTTCTCCAATAA | 92 | 22 |
| 1100501 | 812 | 831 | 27669 | 27688 | CTGAATAGCCCTGCGGAGAT | 82 | 23 |
| 1100503 | 819 | 838 | 27676 | 27695 | TACTTAGCTGAATAGCCCTG | 99 | 24 |
| 1100573 | 1222 | 1241 | 45748 | 45767 | TGACACATTACCAAAGTGGA | 52 | 25 |
| 1100575 | 1225 | 1244 | 45751 | 45770 | CTTTGACACATTACCAAAGT | 94 | 26 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1100609 | 1562 | 1581 | 46088 | 46107 | TGGTTAATAAGAAATGAAAG | 79 | 27 |
| 1100611 | 1566 | 1585 | 46092 | 46111 | AATTTGGTTAATAAGAAATG | 87 | 28 |
| 1100645 | 1758 | 1777 | 46284 | 46303 | AAAAGATTACCATCTTTCAA | 64 | 29 |
| 1100647 | 1760 | 1779 | 46286 | 46305 | AGAAAAGATTACCATCTTTC | 84 | 30 |
| 1100681 | 2005 | 2024 | 46531 | 46550 | TCCTAGTTTTCTCAATTGGA | 94 | 31 |
| 1100683 | 2007 | 2026 | 46533 | 46552 | TCTCCTAGTTTTCTCAATTG | 57 | 32 |
| 1100717 | 2211 | 2230 | 46737 | 46756 | CAAGCTATACCTACTAAAAG | 76 | 33 |
| 1100719 | 2213 | 2232 | 46739 | 46758 | GACAAGCTATACCTACTAAA | 22 | 34 |
| 1100753 | 2319 | 2338 | 46845 | 46864 | CCATTGTTCTTAAGCTATCT | 27 | 35 |
| 1100755 | 2348 | 2367 | 46874 | 46893 | ATTTATAGATCCACTAAGTA | 85 | 36 |
| 1100789 | 2540 | 2559 | 47066 | 47085 | AGCTTATGAACAATTCAACA | 31 | 37 |
| 1100791 | 2545 | 2564 | 47071 | 47090 | ATTTTAGCTTATGAACAATT | 78 | 38 |
| 1100825 | 2659 | 2678 | 47185 | 47204 | TTAGCAATAAATCCTAGATC | 59 | 39 |
| 1100827 | 2661 | 2680 | 47187 | 47206 | AGTTAGCAATAAATCCTAGA | 39 | 40 |
| 1100861 | 2896 | 2915 | 47422 | 47441 | GAGGGAGTAGTACTAAACTC | 57 | 41 |
| 1100863 | 2911 | 2930 | 47437 | 47456 | AGCTTTTTAAATCTTGAGGG | 21 | 42 |
| 1100897 | 3042 | 3061 | 47568 | 47587 | GCTCATCAATTCAAGTGTAT | 31 | 43 |
| 1100899 | 3044 | 3063 | 47570 | 47589 | TAGCTCATCAATTCAAGTGT | 31 | 44 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 7 | 45 |
| 1100934 | 3539 | 3558 | 48065 | 48084 | AAACACATTCAAACGCATCC | 69 | 46 |
| 1100936 | 3541 | 3560 | 48067 | 48086 | ACAAACACATTCAAACGCAT | 65 | 47 |
| 1100970 | 3665 | 3684 | 48191 | 48210 | TGGCCAATCAATTAAGAAAT | 93 | 48 |
| 1100972 | 3671 | 3690 | 48197 | 48216 | TCATACTGGCCAATCAATTA | 68 | 49 |
| 1101006 | 3792 | 3811 | 48318 | 48337 | TTAGTTGTTCCTGACTTTCT | 59 | 50 |
| 1101008 | 3803 | 3822 | 48329 | 48348 | TTCTTGTGAATTTAGTTGTT | 43 | 51 |
| 1101042 | 3918 | 3937 | 48444 | 48463 | GTAATACAAATTATACATTA | 104 | 52 |
| 1101044 | 3921 | 3940 | 48447 | 48466 | CCAGTAATACAAATTATACA | 53 | 53 |
| 1101078 | 4010 | 4029 | 48536 | 48555 | ACTCATTAAATCCATGACAT | 53 | 54 |
| 1101080 | 4012 | 4031 | 48538 | 48557 | TTACTCATTAAATCCATGAC | 62 | 55 |
| 1101114 | 4123 | 4142 | 48649 | 48668 | CAGCCTTTTCAAACAGTTTA | 39 | 56 |
| 1101116 | 4125 | 4144 | 48651 | 48670 | AGCAGCCTTTTCAAACAGTT | 31 | 57 |
| 1101150 | 4402 | 4421 | 48928 | 48947 | TAGTATCAAAAATTCAGACA | 90 | 58 |
| 1101152 | 4757 | 4776 | 49283 | 49302 | GTTTTAAGAATTTAGTAGCT | 71 | 59 |
| 1101186 | 5957 | 5976 | 50483 | 50502 | TCGATACAACAAACAATTCA | 62 | 60 |
| 1101188 | 5959 | 5978 | 50485 | 50504 | ACTCGATACAACAAACAATT | 80 | 61 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1101222 | 6143 | 6162 | 50669 | 50688 | GACTAAAAAAATACAAAGCC | 78 | 62 |
| 1101224 | 6200 | 6219 | 50726 | 50745 | TCAATAATCTTCACTCATGA | 87 | 63 |
| 1101258 | 6539 | 6558 | 51065 | 51084 | ACATTTAAAAATGTATGTTT | 83 | 64 |
| 1101260 | 6551 | 6570 | 51077 | 51096 | AATTAGATAATCACATTTAA | 102 | 65 |
| 1101294 | 6660 | 6679 | 51186 | 51205 | GCCAAACAACAATGCTTTTT | 58 | 66 |
| 1101296 | 6662 | 6681 | 51188 | 51207 | TGGCCAAACAACAATGCTTT | 93 | 67 |
| 1101330 | 6882 | 6901 | 51408 | 51427 | ATTTAATAATCTTTGATATT | 76 | 68 |
| 1101332 | 6890 | 6909 | 51416 | 51435 | TTATCTTTATTTAATAATCT | 87 | 69 |
| 1101366 | 207 | 226 | 13276 | 13295 | CTCCTCCTTCTGCCATTCTC | 57 | 70 |
| 1101368 | 212 | 231 | 13281 | 13300 | AGTAACTCCTCCTTCTGCCA | 43 | 71 |
| 1101438 | N/A | N/A | 53335 | 53354 | CTACCCTAATACAAGAGACT | 108 | 72 |
| 1101440 | N/A | N/A | 53468 | 53487 | AAACCCTACAAATACTGAAT | 102 | 73 |
| 1101582 | N/A | N/A | 4112 | 4131 | AACCAAACCCAAACATCCCG | 59 | 74 |
| 1101584 | N/A | N/A | 4114 | 4133 | GAAACCAAACCCAAACATCC | 87 | 75 |
| 1101618 | N/A | N/A | 4906 | 4925 | TCAGCCTATTTCAAAAGTTT | 100 | 76 |
| 1101620 | N/A | N/A | 4954 | 4973 | AAAATTAGTGACAACTATAC | 78 | 77 |
| 1101654 | N/A | N/A | 6579 | 6598 | AAACTCAAAGCCATCTCTTT | 80 | 78 |
| 1101656 | N/A | N/A | 6594 | 6613 | CCATATATATCTCAGAAACT | 84 | 79 |
| 1101690 | N/A | N/A | 7113 | 7132 | AAGTCATTTATACAGAATTT | 69 | 80 |
| 1101692 | N/A | N/A | 7146 | 7165 | CAGAGGTTTCAAAACCTGTG | 73 | 81 |
| 1101726 | N/A | N/A | 8509 | 8528 | TTATCTCAAACTATCCCCAG | 91 | 82 |
| 1101728 | N/A | N/A | 8512 | 8531 | CCCTTATCTCAAACTATCCC | 99 | 83 |
| 1101762 | N/A | N/A | 9034 | 9053 | AGTTTACAAACTATGGTCAC | 79 | 84 |
| 1101764 | N/A | N/A | 9037 | 9056 | TGGAGTTTACAAACTATGGT | 37 | 85 |
| 1101798 | N/A | N/A | 9800 | 9819 | TAACCAATAATAACTAATAA | 87 | 86 |
| 1101800 | N/A | N/A | 9807 | 9826 | ATTGGTATAACCAATAATAA | 110 | 87 |
| 1101834 | N/A | N/A | 11212 | 11231 | CTGTCCCAAACAACCCTGGA | 88 | 88 |
| 1101836 | N/A | N/A | 11217 | 11236 | CAGAACTGTCCCAAACAACC | 85 | 89 |
| 1101870 | N/A | N/A | 12035 | 12054 | TTACATGATCAAAAATTTAA | 85 | 90 |
| 1101872 | N/A | N/A | 12070 | 12089 | TTTATTTTACAAATCTACCA | 88 | 91 |
| 1101906 | N/A | N/A | 14226 | 14245 | ACGGTGAAACCCCACTATCT | 79 | 92 |
| 1101908 | N/A | N/A | 14332 | 14351 | CTATATAAAAATCTAGTACT | 102 | 93 |
| 1101942 | N/A | N/A | 15045 | 15064 | ATAAACAAAGATATCTGCAG | 98 | 94 |
| 1101944 | N/A | N/A | 15201 | 15220 | AGCAAGGCACAAATAGGAAA | 95 | 95 |
| 1101978 | N/A | N/A | 15710 | 15729 | ATATATCACTAAATCCATAA | 75 | 96 |
| 1101980 | N/A | N/A | 15713 | 15732 | TAGATATATCACTAAATCCA | 77 | 97 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1102014 | N/A | N/A | 16642 | 16661 | ATTAACTTGAAATATTGAAT | 110 | 98 |
| 1102016 | N/A | N/A | 16674 | 16693 | ATCTTTCATTTCTAAAAAAG | 83 | 99 |
| 1102050 | N/A | N/A | 17448 | 17467 | TGACACTATTTCAGGCTTTG | 7 | 100 |
| 1102052 | N/A | N/A | 17466 | 17485 | GAATGCTTTATTCATGCTTG | 31 | 101 |
| 1102086 | N/A | N/A | 18832 | 18851 | TAAGAAAGAACCAACTTAGG | 85 | 102 |
| 1102088 | N/A | N/A | 18841 | 18860 | GAAGAACTTTAAGAAAGAAC | 83 | 103 |
| 1102122 | N/A | N/A | 19392 | 19411 | TAGTGAAAAATATAGTTTTA | 112 | 104 |
| 1102124 | N/A | N/A | 19394 | 19413 | TATAGTGAAAAATATAGTTT | 90 | 105 |
| 1102158 | N/A | N/A | 19863 | 19882 | ACATTTTTTTAAAAGAGATG | 108 | 106 |
| 1102160 | N/A | N/A | 19882 | 19901 | TCACATATAACATATAAACA | 75 | 107 |
| 1102194 | N/A | N/A | 20985 | 21004 | CTGCAGATTTATCACTATTA | 71 | 108 |
| 1102196 | N/A | N/A | 21009 | 21028 | GATCTTAAAAACTACAAGAG | 69 | 109 |
| 1102230 | N/A | N/A | 22011 | 22030 | CGAGTCAGATCCTAAAATCA | 77 | 110 |
| 1102232 | N/A | N/A | 22184 | 22203 | GGTGGTAGTTAAAGAGTAAT | 74 | 111 |
| 1102266 | N/A | N/A | 22927 | 22946 | TAACGGAAAGCCACAAGGAA | 103 | 112 |
| 1102268 | N/A | N/A | 22966 | 22985 | GAACATAATTTTAATTGCTT | 65 | 113 |
| 1102302 | N/A | N/A | 23986 | 24005 | GTATCTAAAATCAAAGAATT | 81 | 114 |
| 1102304 | N/A | N/A | 23989 | 24008 | CAAGTATCTAAAATCAAAGA | 89 | 115 |
| 1102338 | N/A | N/A | 25018 | 25037 | ATGGAAAACCTCAAAATAGT | 81 | 116 |
| 1102340 | N/A | N/A | 25428 | 25447 | TTTAAGTTTCTCTATCATTA | 87 | 117 |
| 1102374 | N/A | N/A | 25709 | 25728 | GTGTGCAATAACTAGTAACA | 33 | 118 |
| 1102376 | N/A | N/A | 25807 | 25826 | TACATTACCCTTCATATATA | 77 | 119 |
| 1102410 | N/A | N/A | 26869 | 26888 | GCCTCATTTTTACCTTTGCT | 64 | 120 |
| 1102412 | N/A | N/A | 26871 | 26890 | AGGCCTCATTTTTACCTTTG | 104 | 121 |
| 1102446 | N/A | N/A | 27823 | 27842 | AAGGGAAAGCCCACTATATA | 90 | 122 |
| 1102448 | N/A | N/A | 27834 | 27853 | TAAGAAATCTAAAGGGAAAG | 93 | 123 |
| 1102482 | N/A | N/A | 28191 | 28210 | TTAACATTTTTCTTTGCCTA | 76 | 124 |
| 1102484 | N/A | N/A | 28228 | 28247 | ACTTCAAACTTTTAATTAAG | 86 | 125 |
| 1102518 | N/A | N/A | 28890 | 28909 | AATCACTGTATTTACCAATT | 99 | 126 |
| 1102520 | N/A | N/A | 28901 | 28920 | CAACAAAAACCAATCACTGT | 98 | 127 |
| 1102554 | N/A | N/A | 29810 | 29829 | GAGTTGATCCAGATTTATGG | 41 | 128 |
| 1102556 | N/A | N/A | 29863 | 29882 | GGAATTCCTATTTAGCAAGC | 78 | 129 |
| 1102590 | N/A | N/A | 30581 | 30600 | TAGAAATATCTCACATTAAG | 70 | 130 |
| 1102592 | N/A | N/A | 30586 | 30605 | AAGACTAGAAATATCTCACA | 56 | 131 |
| 1102626 | N/A | N/A | 31259 | 31278 | TGATTATTATTTTATGACAA | 75 | 132 |
| 1102628 | N/A | N/A | 31312 | 31331 | TATTTTTTACATTAACTAGA | 79 | 133 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1102662 | N/A | N/A | 33021 | 33040 | TCTGAAATAAACATGGTGAA | 72 | 134 |
| 1102664 | N/A | N/A | 33385 | 33404 | TTATAGTTTCTCTATGATGT | 69 | 135 |
| 1102698 | N/A | N/A | 34137 | 34156 | AAGAAGTTAGTTCTTAACTC | 72 | 136 |
| 1102700 | N/A | N/A | 34168 | 34187 | TGAATGCAAGCCATTGTTAA | 52 | 137 |
| 1102734 | N/A | N/A | 34497 | 34516 | GCATGAAAACTATGATTACT | 18 | 138 |
| 1102736 | N/A | N/A | 34499 | 34518 | ATGCATGAAAACTATGATTA | 69 | 139 |
| 1102770 | N/A | N/A | 35322 | 35341 | TTATGTAAACCCCTAATTTC | 109 | 140 |
| 1102772 | N/A | N/A | 35438 | 35457 | TAATATCCTCATTACCCATT | 89 | 141 |
| 1102806 | N/A | N/A | 36969 | 36988 | TTAGCAAATCCTGATGCTGC | 72 | 142 |
| 1102808 | N/A | N/A | 36980 | 36999 | GTATCCTCCCATTAGCAAAT | 35 | 143 |
| 1102842 | N/A | N/A | 37709 | 37728 | TATTATTCCCAAATGGTTCA | 64 | 144 |
| 1102844 | N/A | N/A | 37730 | 37749 | TAATGGAAAATCATATCTGC | 56 | 145 |
| 1102878 | N/A | N/A | 38268 | 38287 | CCTTTGATCAGATAAAGCAT | 62 | 146 |
| 1102880 | N/A | N/A | 38289 | 38308 | GAAAGTCACCAAAAATAAGT | 75 | 147 |
| 1102914 | N/A | N/A | 38842 | 38861 | ACATTGTTTCACGAATCAAA | 65 | 148 |
| 1102916 | N/A | N/A | 38853 | 38872 | ATAAGGAAAATACATTGTTT | 111 | 149 |
| 1100537* | 1088 | 1107 | 45614 | 45633 | CATGGTCACAGCTGCCTGAA | 31 | 150 |
| 1100539* | 1090 | 1109 | 45616 | 45635 | GACATGGTCACAGCTGCCTG | 16 | 151 |
| 1102950* | N/A | N/A | 39345 | 39364 | TGAAGTTTAAATTATTATGT | 79 | 152 |
| 1102952* | N/A | N/A | 39361 | 39380 | ACTGTACAAATTACTGTGAA | 67 | 153 |
| 1102986* | N/A | N/A | 40095 | 40114 | TTATTTCTTCATTAAAGCCA | 50 | 154 |
| 1102988* | N/A | N/A | 40202 | 40221 | CAAAAAAATGCCAAACTGTT | 96 | 155 |
| 1103022* | N/A | N/A | 42830 | 42849 | GCTGTCATTCAAATTGCTTA | 60 | 156 |
| 1103024* | N/A | N/A | 42892 | 42911 | ACTAGAAAAAATGTTGTATG | 74 | 157 |
| 1103058* | N/A | N/A | 44033 | 44052 | TAAAATAGTTTTCTAAATGT | 108 | 158 |
| 1103060* | N/A | N/A | 44071 | 44090 | AATATTAGCCAAAGAGGCAT | 106 | 159 |
| 1103094* | N/A | N/A | 45111 | 45130 | TGTAAAGATATTTAAGAGAG | 75 | 160 |
| 1103096* | N/A | N/A | 45130 | 45149 | CTGTCAATTCAAAGGAAGTT | 51 | 161 |

TABLE 2

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100358 | 16 | 35 | 3395 | 3414 | AACCACCCCCTCCAGCTCCG | 85 | 162 |
| 1100360 | 18 | 37 | 3397 | 3416 | CGAACCACCCCCTCCAGCTC | 111 | 163 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100361 | 19 | 38 | 3398 | 3417 | CCGAACCACCCCCTCCAGCT | 103 | 164 |
| 1100362 | 44 | 63 | 3423 | 3442 | TTGTCTGGAGCCAACGGCCC | 64 | 165 |
| 1100363 | 56 | 75 | 3435 | 3454 | CTCCATGTTTATTTGTCTGG | 97 | 166 |
| 1100364 | 57 | 76 | 3436 | 3455 | ACTCCATGTTTATTTGTCTG | 86 | 167 |
| 1100365 | 63 | 82 | 3442 | 3461 | AGATGGACTCCATGTTTATT | 89 | 168 |
| 1100368 | 312 | 331 | 16178 | 16197 | CCCAAACTTTCAAGGCATTG | 79 | 169 |
| 1100369 | 313 | 332 | 16179 | 16198 | CCCCAAACTTTCAAGGCATT | 30 | 170 |
| 1100370 | 314 | 333 | 16180 | 16199 | ACCCCAAACTTTCAAGGCAT | 36 | 171 |
| 1100371 | 315 | 334 | 16181 | 16200 | AACCCCAAACTTTCAAGGCA | 50 | 172 |
| 1100372 | 316 | 335 | 16182 | 16201 | AAACCCCAAACTTTCAAGGC | 45 | 173 |
| 1100373 | 319 | 338 | 16185 | 16204 | TCTAAACCCCAAACTTTCAA | 57 | 174 |
| 1100374 | 320 | 339 | 16186 | 16205 | TTCTAAACCCCAAACTTTCA | 92 | 175 |
| 1100375 | 321 | 340 | 16187 | 16206 | GTTCTAAACCCCAAACTTTC | 48 | 176 |
| 1100376 | 322 | 341 | 16188 | 16207 | AGTTCTAAACCCCAAACTTT | 63 | 177 |
| 1100377 | 323 | 342 | 16189 | 16208 | TAGTTCTAAACCCCAAACTT | 81 | 178 |
| 1100378 | 324 | 343 | 16190 | 16209 | TTAGTTCTAAACCCCAAACT | 58 | 179 |
| 1100379 | 326 | 345 | 16192 | 16211 | GATTAGTTCTAAACCCCAAA | 15 | 180 |
| 1100380 | 327 | 346 | 16193 | 16212 | GGATTAGTTCTAAACCCCAA | 25 | 181 |
| 1100381 | 328 | 347 | 16194 | 16213 | AGGATTAGTTCTAAACCCCA | 23 | 182 |
| 1100382 | 330 | 349 | 16196 | 16215 | ACAGGATTAGTTCTAAACCC | 24 | 183 |
| 1100383 | 338 | 357 | 16204 | 16223 | ACTGTTGAACAGGATTAGTT | 64 | 184 |
| 1100384 | 356 | 375 | 16222 | 16241 | GAGCCTCTGATACTCTGGAC | 23 | 185 |
| 1100385 | 357 | 376 | 16223 | 16242 | TGAGCCTCTGATACTCTGGA | 51 | 186 |
| 1100386 | 359 | 378 | 16225 | 16244 | CCTGAGCCTCTGATACTCTG | 88 | 187 |
| 1100387 | 363 | 382 | 16229 | 16248 | CGATCCTGAGCCTCTGATAC | 41 | 188 |
| 1100388 | 368 | 387 | 16234 | 16253 | AGGATCGATCCTGAGCCTCT | 78 | 189 |
| 1100389 | 369 | 388 | 16235 | 16254 | TAGGATCGATCCTGAGCCTC | 91 | 190 |
| 1100390 | 371 | 390 | N/A | N/A | TATAGGATCGATCCTGAGCC | 60 | 191 |
| 1100391 | 372 | 391 | N/A | N/A | TTATAGGATCGATCCTGAGC | 71 | 192 |
| 1100392 | 381 | 400 | N/A | N/A | ATCTTTCATTTATAGGATCG | 59 | 193 |
| 1100394 | 384 | 403 | N/A | N/A | ATGATCTTTCATTTATAGGA | 92 | 194 |
| 1100396 | 391 | 410 | 16684 | 16703 | CATATAAATGATCTTTCATT | 79 | 195 |
| 1100397 | 392 | 411 | 16685 | 16704 | GCATATAAATGATCTTTCAT | 7 | 196 |
| 1100398 | 393 | 412 | 16686 | 16705 | TGCATATAAATGATCTTTCA | 12 | 197 |
| 1100399 | 394 | 413 | 16687 | 16706 | TTGCATATAAATGATCTTTC | 13 | 198 |
| 1100400 | 395 | 414 | 16688 | 16707 | ATTGCATATAAATGATCTTT | 31 | 199 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100401 | 397 | 416 | 16690 | 16709 | TAATTGCATATAAATGATCT | 68 | 200 |
| 1100402 | 403 | 422 | 16696 | 16715 | TCCTTATAATTGCATATAAA | 35 | 201 |
| 1100403 | 406 | 425 | 16699 | 16718 | TGTTCCTTATAATTGCATAT | 15 | 202 |
| 1100404 | 407 | 426 | 16700 | 16719 | GTGTTCCTTATAATTGCATA | 76 | 203 |
| 1100405 | 408 | 427 | 16701 | 16720 | AGTGTTCCTTATAATTGCAT | 7 | 204 |
| 1100406 | 409 | 428 | 16702 | 16721 | CAGTGTTCCTTATAATTGCA | 7 | 205 |
| 1100407 | 410 | 429 | 16703 | 16722 | CCAGTGTTCCTTATAATTGC | 10 | 206 |
| 1100408 | 411 | 430 | 16704 | 16723 | ACCAGTGTTCCTTATAATTG | 7 | 207 |
| 1100409 | 412 | 431 | 16705 | 16724 | AACCAGTGTTCCTTATAATT | 12 | 208 |
| 1100410 | 417 | 436 | 16710 | 16729 | CTGTAAACCAGTGTTCCTTA | 19 | 209 |
| 1100411 | 420 | 439 | 16713 | 16732 | TAACTGTAAACCAGTGTTCC | 80 | 210 |
| 1100412 | 421 | 440 | 16714 | 16733 | CTAACTGTAAACCAGTGTTC | 32 | 211 |
| 1100413 | 427 | 446 | 16720 | 16739 | AATTTTCTAACTGTAAACCA | 86 | 212 |
| 1100414 | 430 | 449 | 16723 | 16742 | CCTAATTTTCTAACTGTAAA | 79 | 213 |
| 1100415 | 431 | 450 | 16724 | 16743 | TCCTAATTTTCTAACTGTAA | 81 | 214 |
| 1100416 | 432 | 451 | 16725 | 16744 | TTCCTAATTTTCTAACTGTA | 71 | 215 |
| 1100417 | 433 | 452 | 16726 | 16745 | TTTCCTAATTTTCTAACTGT | 68 | 216 |
| 1100418 | 435 | 454 | 16728 | 16747 | GTTTTCCTAATTTTCTAACT | 75 | 217 |
| 1100419 | 438 | 457 | N/A | N/A | ACTGTTTTCCTAATTTTCTA | 56 | 218 |
| 1100420 | 440 | 459 | N/A | N/A | CCACTGTTTTCCTAATTTTC | 46 | 219 |
| 1100421 | 441 | 460 | N/A | N/A | ACCACTGTTTTCCTAATTTT | 38 | 220 |
| 1100422 | 442 | 461 | N/A | N/A | AACCACTGTTTTCCTAATTT | 48 | 221 |
| 1100423 | 447 | 466 | N/A | N/A | AGTTAAACCACTGTTTTCCT | 49 | 222 |
| 1100424 | 448 | 467 | N/A | N/A | AAGTTAAACCACTGTTTTCC | 58 | 223 |
| 1100425 | 450 | 469 | N/A | N/A | TCAAGTTAAACCACTGTTTT | 60 | 224 |
| 1100426 | 451 | 470 | N/A | N/A | TTCAAGTTAAACCACTGTTT | 60 | 225 |
| 1100427 | 453 | 472 | N/A | N/A | AATTCAAGTTAAACCACTGT | 66 | 226 |
| 1100428 | 456 | 475 | 21183 | 21202 | GAGAATTCAAGTTAAACCAC | 37 | 227 |
| 1100430 | 463 | 482 | 21190 | 21209 | GTCAAGAGAGAATTCAAGTT | 22 | 228 |
| 1100432 | 472 | 491 | 21199 | 21218 | TCTGGACCCGTCAAGAGAGA | 40 | 229 |
| 1100433 | 493 | 512 | 21220 | 21239 | AGATATGTATCTGATATTAA | 47 | 230 |
| 1100434 | 500 | 519 | 21227 | 21246 | AAGTGCAAGATATGTATCTG | 20 | 231 |
| 1100435 | 501 | 520 | 21228 | 21247 | AAAGTGCAAGATATGTATCT | 34 | 232 |
| 1100436 | 502 | 521 | 21229 | 21248 | AAAAGTGCAAGATATGTATC | 51 | 233 |
| 1100437 | 507 | 526 | 21234 | 21253 | CCAAGAAAAGTGCAAGATAT | 45 | 234 |
| 1100438 | 511 | 530 | 21238 | 21257 | TGAGCCAAGAAAAGTGCAAG | 77 | 235 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100439 | 512 | 531 | 21239 | 21258 | TTGAGCCAAGAAAAGTGCAA | 78 | 236 |
| 1100440 | 515 | 534 | 21242 | 21261 | TAATTGAGCCAAGAAAAGTG | 75 | 237 |
| 1100441 | 517 | 536 | 21244 | 21263 | TGTAATTGAGCCAAGAAAAG | 77 | 238 |
| 1100442 | 522 | 541 | 21249 | 21268 | CCTGTTGTAATTGAGCCAAG | 42 | 239 |
| 1100443 | 531 | 550 | N/A | N/A | AATAACCTTCCTGTTGTAAT | 61 | 240 |
| 1100444 | 532 | 551 | N/A | N/A | GAATAACCTTCCTGTTGTAA | 54 | 241 |
| 1100445 | 533 | 552 | N/A | N/A | AGAATAACCTTCCTGTTGTA | 47 | 242 |
| 1100446 | 534 | 553 | N/A | N/A | TAGAATAACCTTCCTGTTGT | 51 | 243 |
| 1100447 | 535 | 554 | N/A | N/A | ATAGAATAACCTTCCTGTTG | 62 | 244 |
| 1100448 | 536 | 555 | N/A | N/A | TATAGAATAACCTTCCTGTT | 64 | 245 |
| 1100449 | 537 | 556 | N/A | N/A | ATATAGAATAACCTTCCTGT | 80 | 246 |
| 1100450 | 539 | 558 | N/A | N/A | AAATATAGAATAACCTTCCT | 73 | 247 |
| 1100451 | 540 | 559 | N/A | N/A | CAAATATAGAATAACCTTCC | 73 | 248 |
| 1100452 | 541 | 560 | N/A | N/A | ACAAATATAGAATAACCTTC | 76 | 249 |
| 1100453 | 546 | 565 | 26744 | 26763 | TAACGACAAATATAGAATAA | 93 | 250 |
| 1100454 | 558 | 577 | 26756 | 26775 | GCAGATCACCCTTAACGACA | 26 | 251 |
| 1100455 | 561 | 580 | 26759 | 26778 | CTGGCAGATCACCCTTAACG | 35 | 252 |
| 1100456 | 563 | 582 | 26761 | 26780 | ATCTGGCAGATCACCCTTAA | 54 | 253 |
| 1100457 | 564 | 583 | 26762 | 26781 | AATCTGGCAGATCACCCTTA | 75 | 254 |
| 1100458 | 565 | 584 | 26763 | 26782 | CAATCTGGCAGATCACCCTT | 49 | 255 |
| 1100459 | 566 | 585 | 26764 | 26783 | GCAATCTGGCAGATCACCCT | 48 | 256 |
| 1100460 | 567 | 586 | 26765 | 26784 | CGCAATCTGGCAGATCACCC | 60 | 257 |
| 1100461 | 568 | 587 | 26766 | 26785 | TCGCAATCTGGCAGATCACC | 48 | 258 |
| 1100462 | 569 | 588 | 26767 | 26786 | TTCGCAATCTGGCAGATCAC | 87 | 259 |
| 1100463 | 571 | 590 | 26769 | 26788 | GCTTCGCAATCTGGCAGATC | 67 | 260 |
| 1100464 | 635 | 654 | 26833 | 26852 | TTCTTCTCCAATAAGTTTTG | 81 | 261 |
| 1100466 | 639 | 658 | 26837 | 26856 | CTAATTCTTCTCCAATAAGT | 96 | 262 |
| 1100468 | 642 | 661 | 26840 | 26859 | GTGCTAATTCTTCTCCAATA | 23 | 263 |
| 1100469 | 644 | 663 | 26842 | 26861 | TTGTGCTAATTCTTCTCCAA | 72 | 264 |
| 1100470 | 645 | 664 | 26843 | 26862 | GTTGTGCTAATTCTTCTCCA | 34 | 265 |
| 1100471 | 675 | 694 | N/A | N/A | GGTCTGTTTTATGGACTCTT | 60 | 266 |
| 1100472 | 677 | 696 | 27534 | 27553 | CAGGTCTGTTTTATGGACTC | 86 | 267 |
| 1100473 | 678 | 697 | 27535 | 27554 | CCAGGTCTGTTTTATGGACT | 69 | 268 |
| 1100474 | 700 | 719 | 27557 | 27576 | TCATTTGCTTCTAACACTCG | 87 | 269 |
| 1100475 | 705 | 724 | 27562 | 27581 | AGCCATCATTTGCTTCTAAC | 19 | 270 |
| 1100476 | 711 | 730 | 27568 | 27587 | TTCCTGAGCCATCATTTGCT | 80 | 271 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100477 | 712 | 731 | 27569 | 27588 | ATTCCTGAGCCATCATTTGC | 52 | 272 |
| 1100478 | 713 | 732 | 27570 | 27589 | CATTCCTGAGCCATCATTTG | 56 | 273 |
| 1100479 | 718 | 737 | 27575 | 27594 | TCTAACATTCCTGAGCCATC | 18 | 274 |
| 1100480 | 739 | 758 | 27596 | 27615 | TGCAAATCCTCCTCATCTTC | 42 | 275 |
| 1100481 | 740 | 759 | 27597 | 27616 | CTGCAAATCCTCCTCATCTT | 53 | 276 |
| 1100482 | 741 | 760 | 27598 | 27617 | TCTGCAAATCCTCCTCATCT | 53 | 277 |
| 1100483 | 742 | 761 | 27599 | 27618 | CTCTGCAAATCCTCCTCATC | 64 | 278 |
| 1100484 | 743 | 762 | 27600 | 27619 | CCTCTGCAAATCCTCCTCAT | 46 | 279 |
| 1100485 | 745 | 764 | 27602 | 27621 | GCCCTCTGCAAATCCTCCTC | 58 | 280 |
| 1100486 | 752 | 771 | 27609 | 27628 | TGCCAGAGCCCTCTGCAAAT | 68 | 281 |
| 1100487 | 754 | 773 | 27611 | 27630 | AGTGCCAGAGCCCTCTGCAA | 64 | 282 |
| 1100488 | 760 | 779 | 27617 | 27636 | CGACTTAGTGCCAGAGCCCT | 86 | 283 |
| 1100489 | 762 | 781 | 27619 | 27638 | GGCGACTTAGTGCCAGAGCC | 83 | 284 |
| 1100490 | 767 | 786 | 27624 | 27643 | TTCTTGGCGACTTAGTGCCA | 59 | 285 |
| 1100491 | 776 | 795 | 27633 | 27652 | CATGTCAATTTCTTGGCGAC | 83 | 286 |
| 1100492 | 777 | 796 | 27634 | 27653 | CCATGTCAATTTCTTGGCGA | 72 | 287 |
| 1100493 | 786 | 805 | 27643 | 27662 | CCTCATCTTCCATGTCAATT | 66 | 288 |
| 1100494 | 788 | 807 | 27645 | 27664 | TTCCTCATCTTCCATGTCAA | 52 | 289 |
| 1100495 | 789 | 808 | 27646 | 27665 | CTTCCTCATCTTCCATGTCA | 47 | 290 |
| 1100496 | 792 | 811 | 27649 | 27668 | CTGCTTCCTCATCTTCCATG | 28 | 291 |
| 1100497 | 793 | 812 | 27650 | 27669 | TCTGCTTCCTCATCTTCCAT | 33 | 292 |
| 1100498 | 794 | 813 | 27651 | 27670 | ATCTGCTTCCTCATCTTCCA | 37 | 293 |
| 1100499 | 795 | 814 | 27652 | 27671 | GATCTGCTTCCTCATCTTCC | 43 | 294 |
| 1100500 | 796 | 815 | 27653 | 27672 | AGATCTGCTTCCTCATCTTC | 45 | 295 |
| 1100502 | 814 | 833 | 27671 | 27690 | AGCTGAATAGCCCTGCGGAG | 68 | 296 |
| 1100504 | 827 | 846 | 27684 | 27703 | ACCTTGCATACTTAGCTGAA | 77 | 297 |
| 1100505 | 833 | 852 | N/A | N/A | GGAACTACCTTGCATACTTA | 20 | 298 |
| 1100506 | 836 | 855 | N/A | N/A | TCTGGAACTACCTTGCATAC | 47 | 299 |
| 1100507 | 838 | 857 | N/A | N/A | TTTCTGGAACTACCTTGCAT | 69 | 300 |
| 1100508 | 875 | 894 | 28970 | 28989 | ATTTGTACCTGATGTCTGTG | 30 | 301 |
| 1100509 | 877 | 896 | 28972 | 28991 | AGATTTGTACCTGATGTCTG | 50 | 302 |
| 1100510 | 883 | 902 | 28978 | 28997 | GAAGTAAGATTTGTACCTGA | 41 | 303 |
| 1100511 | 885 | 904 | 28980 | 28999 | CTGAAGTAAGATTTGTACCT | 91 | 304 |
| 1100512 | 886 | 905 | 28981 | 29000 | TCTGAAGTAAGATTTGTACC | 91 | 305 |
| 1100513 | 904 | 923 | 28999 | 29018 | CGTCTCTTCCGAAGCTCTTC | 69 | 306 |
| 1100514 | 926 | 945 | N/A | N/A | CTGTTTTTCAAAGTAGGCTT | 41 | 307 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100515 | 927 | 946 | N/A | N/A | GCTGTTTTTCAAAGTAGGCT | 67 | 308 |
| 1100516 | 928 | 947 | N/A | N/A | TGCTGTTTTTCAAAGTAGGC | 43 | 309 |
| 1100517 | 929 | 948 | N/A | N/A | CTGCTGTTTTTCAAAGTAGG | 81 | 310 |
| 1100518 | 930 | 949 | N/A | N/A | GCTGCTGTTTTTCAAAGTAG | 65 | 311 |
| 1100519 | 931 | 950 | N/A | N/A | TGCTGCTGTTTTTCAAAGTA | 44 | 312 |
| 1100557 | 1120 | 1139 | 45646 | 45665 | GTTTTCAAATCATTTCTGAC | 19 | 313 |
| 1100558 | 1121 | 1140 | 45647 | 45666 | TGTTTTCAAATCATTTCTGA | 40 | 314 |
| 1100559 | 1122 | 1141 | 45648 | 45667 | CTGTTTTCAAATCATTTCTG | 12 | 315 |
| 1100560 | 1126 | 1145 | 45652 | 45671 | CCTTCTGTTTTCAAATCATT | 20 | 316 |
| 1100561 | 1127 | 1146 | 45653 | 45672 | TCCTTCTGTTTTCAAATCAT | 20 | 317 |
| 1100562 | 1143 | 1162 | 45669 | 45688 | AAAGGTATTATTTTTTTCCT | 39 | 318 |
| 1100563 | 1144 | 1163 | 45670 | 45689 | TAAAGGTATTATTTTTTTCC | 29 | 319 |
| 1100564 | 1145 | 1164 | 45671 | 45690 | TTAAAGGTATTATTTTTTTC | 122 | 320 |
| 1100565 | 1167 | 1186 | 45693 | 45712 | GTATGAATATCTAAATTATT | 80 | 321 |
| 1100566 | 1172 | 1191 | 45698 | 45717 | GGAAAGTATGAATATCTAAA | 3 | 322 |
| 1100567 | 1176 | 1195 | 45702 | 45721 | TGTTGGAAAGTATGAATATC | 19 | 323 |
| 1100568 | 1209 | 1228 | 45735 | 45754 | AAGTGGACCCTATGCTGTAA | 20 | 324 |
| 1100569 | 1210 | 1229 | 45736 | 45755 | AAAGTGGACCCTATGCTGTA | 50 | 325 |
| 1100570 | 1211 | 1230 | 45737 | 45756 | CAAAGTGGACCCTATGCTGT | 85 | 326 |
| 1100571 | 1220 | 1239 | 45746 | 45765 | ACACATTACCAAAGTGGACC | 14 | 327 |
| 1100572 | 1221 | 1240 | 45747 | 45766 | GACACATTACCAAAGTGGAC | 13 | 328 |
| 1100574 | 1223 | 1242 | 45749 | 45768 | TTGACACATTACCAAAGTGG | 25 | 329 |
| 1100576 | 1226 | 1245 | 45752 | 45771 | TCTTTGACACATTACCAAAG | 64 | 330 |
| 1100577 | 1227 | 1246 | 45753 | 45772 | CTCTTTGACACATTACCAAA | 35 | 331 |
| 1100578 | 1228 | 1247 | 45754 | 45773 | TCTCTTTGACACATTACCAA | 54 | 332 |
| 1100579 | 1230 | 1249 | 45756 | 45775 | CATCTCTTTGACACATTACC | 34 | 333 |
| 1100580 | 1232 | 1251 | 45758 | 45777 | CTCATCTCTTTGACACATTA | 16 | 334 |
| 1100581 | 1235 | 1254 | 45761 | 45780 | TTCCTCATCTCTTTGACACA | 33 | 335 |
| 1100582 | 1240 | 1259 | 45766 | 45785 | CTTATTTCCTCATCTCTTTG | 33 | 336 |
| 1100583 | 1243 | 1262 | 45769 | 45788 | AGTCTTATTTCCTCATCTCT | 17 | 337 |
| 1100584 | 1244 | 1263 | 45770 | 45789 | AAGTCTTATTTCCTCATCTC | 81 | 338 |
| 1100585 | 1245 | 1264 | 45771 | 45790 | AAAGTCTTATTTCCTCATCT | 10 | 339 |
| 1100586 | 1246 | 1265 | 45772 | 45791 | AAAAGTCTTATTTCCTCATC | 31 | 340 |
| 1100587 | 1307 | 1326 | 45833 | 45852 | TTATTTAGTCCTACAACCGA | 62 | 341 |
| 1100588 | 1311 | 1330 | 45837 | 45856 | ATCATTATTTAGTCCTACAA | 30 | 342 |
| 1100589 | 1314 | 1333 | 45840 | 45859 | AAGATCATTATTTAGTCCTA | 17 | 343 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100590 | 1317 | 1336 | 45843 | 45862 | TGGAAGATCATTATTTAGTC | 6 | 344 |
| 1100591 | 1318 | 1337 | 45844 | 45863 | TTGGAAGATCATTATTTAGT | 11 | 345 |
| 1100592 | 1319 | 1338 | 45845 | 45864 | TTTGGAAGATCATTATTTAG | 23 | 346 |
| 1100593 | 1321 | 1340 | 45847 | 45866 | TATTTGGAAGATCATTATTT | 66 | 347 |
| 1100594 | 1322 | 1341 | 45848 | 45867 | ATATTTGGAAGATCATTATT | 84 | 348 |
| 1100595 | 1331 | 1350 | 45857 | 45876 | CTTTGGCTAATATTTGGAAG | 37 | 349 |
| 1100596 | 1332 | 1351 | 45858 | 45877 | TCTTTGGCTAATATTTGGAA | 43 | 350 |
| 1100597 | 1333 | 1352 | 45859 | 45878 | CTCTTTGGCTAATATTTGGA | 12 | 351 |
| 1100598 | 1344 | 1363 | 45870 | 45889 | TTGCTGAATGCCTCTTTGGC | 33 | 352 |
| 1100599 | 1400 | 1419 | 45926 | 45945 | TTGCACACTCAAAAAAGAAA | 72 | 353 |
| 1100600 | 1402 | 1421 | 45928 | 45947 | TATTGCACACTCAAAAAAGA | 105 | 354 |
| 1100601 | 1403 | 1422 | 45929 | 45948 | ATATTGCACACTCAAAAAAG | 70 | 355 |
| 1100602 | 1441 | 1460 | 45967 | 45986 | AAGATCCAAGAAAAATGCCC | 78 | 356 |
| 1100603 | 1447 | 1466 | 45973 | 45992 | TGCAAAAAGATCCAAGAAAA | 105 | 357 |
| 1100604 | 1448 | 1467 | 45974 | 45993 | CTGCAAAAAGATCCAAGAAA | 65 | 358 |
| 1100605 | 1449 | 1468 | 45975 | 45994 | TCTGCAAAAAGATCCAAGAA | 68 | 359 |
| 1100606 | 1498 | 1517 | 46024 | 46043 | AGAAAACAAACTATATGGAA | 87 | 360 |
| 1100607 | 1550 | 1569 | 46076 | 46095 | AATGAAAGCCACTATTACAT | 74 | 361 |
| 1100608 | 1552 | 1571 | 46078 | 46097 | GAAATGAAAGCCACTATTAC | 59 | 362 |
| 1100610 | 1565 | 1584 | 46091 | 46110 | ATTTGGTTAATAAGAAATGA | 103 | 363 |
| 1100612 | 1567 | 1586 | 46093 | 46112 | TAATTTGGTTAATAAGAAAT | 87 | 364 |
| 1100613 | 1575 | 1594 | 46101 | 46120 | TGAAAGGTTAATTTGGTTAA | 93 | 365 |
| 1100614 | 1576 | 1595 | 46102 | 46121 | CTGAAAGGTTAATTTGGTTA | 70 | 366 |
| 1100615 | 1583 | 1602 | 46109 | 46128 | TACTTTCCTGAAAGGTTAAT | 109 | 367 |
| 1100616 | 1586 | 1605 | 46112 | 46131 | AGATACTTTCCTGAAAGGTT | 72 | 368 |
| 1100617 | 1587 | 1606 | 46113 | 46132 | GAGATACTTTCCTGAAAGGT | 97 | 369 |
| 1100618 | 1588 | 1607 | 46114 | 46133 | AGAGATACTTTCCTGAAAGG | 107 | 370 |
| 1100619 | 1611 | 1630 | 46137 | 46156 | ACTATTATCAACATCAGGAA | 90 | 371 |
| 1100620 | 1619 | 1638 | 46145 | 46164 | GAACCATTACTATTATCAAC | 120 | 372 |
| 1100621 | 1620 | 1639 | 46146 | 46165 | AGAACCATTACTATTATCAA | 31 | 373 |
| 1100622 | 1621 | 1640 | 46147 | 46166 | TAGAACCATTACTATTATCA | 31 | 374 |
| 1100623 | 1623 | 1642 | 46149 | 46168 | TCTAGAACCATTACTATTAT | 81 | 375 |
| 1100624 | 1624 | 1643 | 46150 | 46169 | TTCTAGAACCATTACTATTA | 60 | 376 |
| 1100625 | 1625 | 1644 | 46151 | 46170 | CTTCTAGAACCATTACTATT | 78 | 377 |
| 1100626 | 1626 | 1645 | 46152 | 46171 | CCTTCTAGAACCATTACTAT | 46 | 378 |
| 1100627 | 1627 | 1646 | 46153 | 46172 | TCCTTCTAGAACCATTACTA | 60 | 379 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100628 | 1679 | 1698 | 46205 | 46224 | ACACAAGAAAACACTGGAGC | 36 | 380 |
| 1100629 | 1681 | 1700 | 46207 | 46226 | CAACACAAGAAAACACTGGA | 72 | 381 |
| 1100630 | 1691 | 1710 | 46217 | 46236 | TCAGAGAAAACAACACAAGA | 70 | 382 |
| 1100631 | 1721 | 1740 | 46247 | 46266 | AATGAAAACCAGGTAGCAGA | 64 | 383 |
| 1100632 | 1723 | 1742 | 46249 | 46268 | ATAATGAAAACCAGGTAGCA | 77 | 384 |
| 1100633 | 1727 | 1746 | 46253 | 46272 | GAAAATAATGAAAACCAGGT | 63 | 385 |
| 1100634 | 1731 | 1750 | 46257 | 46276 | GTGGGAAAATAATGAAAACC | 35 | 386 |
| 1100635 | 1732 | 1751 | 46258 | 46277 | TGTGGGAAAATAATGAAAAC | 73 | 387 |
| 1100636 | 1733 | 1752 | 46259 | 46278 | TTGTGGGAAAATAATGAAAA | 71 | 388 |
| 1100637 | 1743 | 1762 | 46269 | 46288 | TTCAAAAGAATTGTGGGAAA | 81 | 389 |
| 1100638 | 1745 | 1764 | 46271 | 46290 | CTTTCAAAAGAATTGTGGGA | 44 | 390 |
| 1100639 | 1746 | 1765 | 46272 | 46291 | TCTTTCAAAAGAATTGTGGG | 42 | 391 |
| 1100640 | 1748 | 1767 | 46274 | 46293 | CATCTTTCAAAAGAATTGTG | 66 | 392 |
| 1100641 | 1749 | 1768 | 46275 | 46294 | CCATCTTTCAAAAGAATTGT | 26 | 393 |
| 1100642 | 1750 | 1769 | 46276 | 46295 | ACCATCTTTCAAAAGAATTG | 52 | 394 |
| 1100643 | 1754 | 1773 | 46280 | 46299 | GATTACCATCTTTCAAAAGA | 44 | 395 |
| 1100644 | 1757 | 1776 | 46283 | 46302 | AAAGATTACCATCTTTCAAA | 96 | 396 |
| 1100646 | 1759 | 1778 | 46285 | 46304 | GAAAAGATTACCATCTTTCA | 39 | 397 |
| 1100648 | 1761 | 1780 | 46287 | 46306 | CAGAAAAGATTACCATCTTT | 91 | 398 |
| 1100649 | 1762 | 1781 | 46288 | 46307 | TCAGAAAAGATTACCATCTT | 66 | 399 |
| 1100650 | 1763 | 1782 | 46289 | 46308 | CTCAGAAAAGATTACCATCT | 67 | 400 |
| 1100651 | 1764 | 1783 | 46290 | 46309 | CCTCAGAAAAGATTACCATC | 62 | 401 |
| 1100652 | 1772 | 1791 | 46298 | 46317 | ACGCTAAACCTCAGAAAAGA | 67 | 402 |
| 1100653 | 1804 | 1823 | 46330 | 46349 | CATGAAATAATGATCCCATC | 98 | 403 |
| 1100654 | 1805 | 1824 | 46331 | 46350 | TCATGAAATAATGATCCCAT | 60 | 404 |
| 1100655 | 1806 | 1825 | 46332 | 46351 | GTCATGAAATAATGATCCCA | 44 | 405 |
| 1100656 | 1807 | 1826 | 46333 | 46352 | AGTCATGAAATAATGATCCC | 94 | 406 |
| 1100657 | 1808 | 1827 | 46334 | 46353 | CAGTCATGAAATAATGATCC | 68 | 407 |
| 1100658 | 1809 | 1828 | 46335 | 46354 | CCAGTCATGAAATAATGATC | 54 | 408 |
| 1100659 | 1810 | 1829 | 46336 | 46355 | ACCAGTCATGAAATAATGAT | 80 | 409 |
| 1100660 | 1819 | 1838 | 46345 | 46364 | TAGGAACGCACCAGTCATGA | 38 | 410 |
| 1100661 | 1821 | 1840 | 46347 | 46366 | TTTAGGAACGCACCAGTCAT | 50 | 411 |
| 1100662 | 1822 | 1841 | 46348 | 46367 | GTTTAGGAACGCACCAGTCA | 55 | 412 |
| 1100663 | 1823 | 1842 | 46349 | 46368 | AGTTTAGGAACGCACCAGTC | 35 | 413 |
| 1100664 | 1824 | 1843 | 46350 | 46369 | GAGTTTAGGAACGCACCAGT | 31 | 414 |
| 1100665 | 1825 | 1844 | 46351 | 46370 | AGAGTTTAGGAACGCACCAG | 22 | 415 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100666 | 1826 | 1845 | 46352 | 46371 | CAGAGTTTAGGAACGCACCA | 16 | 416 |
| 1100667 | 1827 | 1846 | 46353 | 46372 | TCAGAGTTTAGGAACGCACC | 13 | 417 |
| 1100668 | 1829 | 1848 | 46355 | 46374 | TTTCAGAGTTTAGGAACGCA | 16 | 418 |
| 1100669 | 1835 | 1854 | 46361 | 46380 | GGCTGATTTCAGAGTTTAGG | 12 | 419 |
| 1100670 | 1860 | 1879 | 46386 | 46405 | CATTTATTCTCAAGTACTTG | 25 | 420 |
| 1100671 | 1861 | 1880 | 46387 | 46406 | TCATTTATTCTCAAGTACTT | 40 | 421 |
| 1100672 | 1862 | 1881 | 46388 | 46407 | CTCATTTATTCTCAAGTACT | 31 | 422 |
| 1100673 | 1863 | 1882 | 46389 | 46408 | GCTCATTTATTCTCAAGTAC | 12 | 423 |
| 1100674 | 1868 | 1887 | 46394 | 46413 | AAAATGCTCATTTATTCTCA | 49 | 424 |
| 1100675 | 1889 | 1908 | 46415 | 46434 | GCACATGCTCACACATTTTA | 43 | 425 |
| 1100676 | 1927 | 1946 | 46453 | 46472 | GATATAAGTGAAAAGACATT | 80 | 426 |
| 1100677 | 1953 | 1972 | 46479 | 46498 | GGGTTGCAACAAAGCTGTAA | 40 | 427 |
| 1100678 | 1980 | 1999 | 46506 | 46525 | AAGGAAAAAATAAGGCGCAG | 71 | 428 |
| 1100679 | 1982 | 2001 | 46508 | 46527 | GAAAGGAAAAAATAAGGCGC | 97 | 429 |
| 1100680 | 2004 | 2023 | 46530 | 46549 | CCTAGTTTTCTCAATTGGAG | 98 | 430 |
| 1100682 | 2006 | 2025 | 46532 | 46551 | CTCCTAGTTTTCTCAATTGG | 53 | 431 |
| 1100684 | 2009 | 2028 | 46535 | 46554 | CTTCTCCTAGTTTTCTCAAT | 45 | 432 |
| 1100685 | 2014 | 2033 | 46540 | 46559 | CTATGCTTCTCCTAGTTTTC | 50 | 433 |
| 1100686 | 2015 | 2034 | 46541 | 46560 | ACTATGCTTCTCCTAGTTTT | 61 | 434 |
| 1100687 | 2023 | 2042 | 46549 | 46568 | GCCTGCATACTATGCTTCTC | 68 | 435 |
| 1100688 | 2024 | 2043 | 46550 | 46569 | TGCCTGCATACTATGCTTCT | 92 | 436 |
| 1100689 | 2030 | 2049 | 46556 | 46575 | GAGACTTGCCTGCATACTAT | 33 | 437 |
| 1100690 | 2045 | 2064 | 46571 | 46590 | GTCTTCTAACAGAAGGAGAC | 125 | 438 |
| 1100691 | 2046 | 2065 | 46572 | 46591 | AGTCTTCTAACAGAAGGAGA | 137 | 439 |
| 1100692 | 2047 | 2066 | 46573 | 46592 | TAGTCTTCTAACAGAAGGAG | 72 | 440 |
| 1100693 | 2048 | 2067 | 46574 | 46593 | TTAGTCTTCTAACAGAAGGA | 81 | 441 |
| 1100694 | 2049 | 2068 | 46575 | 46594 | TTTAGTCTTCTAACAGAAGG | 85 | 442 |
| 1100695 | 2050 | 2069 | 46576 | 46595 | GTTTAGTCTTCTAACAGAAG | 42 | 443 |
| 1100696 | 2052 | 2071 | 46578 | 46597 | ATGTTTAGTCTTCTAACAGA | 43 | 444 |
| 1100697 | 2054 | 2073 | 46580 | 46599 | GTATGTTTAGTCTTCTAACA | 19 | 445 |
| 1100698 | 2091 | 2110 | 46617 | 46636 | GGCCAAATTTCATGTATCAT | 35 | 446 |
| 1100699 | 2093 | 2112 | 46619 | 46638 | AAGGCCAAATTTCATGTATC | 48 | 447 |
| 1100700 | 2094 | 2113 | 46620 | 46639 | GAAGGCCAAATTTCATGTAT | 34 | 448 |
| 1100701 | 2097 | 2116 | 46623 | 46642 | ATTGAAGGCCAAATTTCATG | 48 | 449 |
| 1100702 | 2105 | 2124 | 46631 | 46650 | CTATTAAAATTGAAGGCCAA | 77 | 450 |
| 1100703 | 2106 | 2125 | 46632 | 46651 | GCTATTAAAATTGAAGGCCA | 48 | 451 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100704 | 2108 | 2127 | 46634 | 46653 | CTGCTATTAAAATTGAAGGC | 25 | 452 |
| 1100705 | 2109 | 2128 | 46635 | 46654 | ACTGCTATTAAAATTGAAGG | 35 | 453 |
| 1100706 | 2110 | 2129 | 46636 | 46655 | AACTGCTATTAAAATTGAAG | 71 | 454 |
| 1100707 | 2111 | 2130 | 46637 | 46656 | AAACTGCTATTAAAATTGAA | 78 | 455 |
| 1100708 | 2112 | 2131 | 46638 | 46657 | AAAACTGCTATTAAAATTGA | 111 | 456 |
| 1100709 | 2168 | 2187 | 46694 | 46713 | CATGACTCAACTGTAAAGAG | 29 | 457 |
| 1100710 | 2204 | 2223 | 46730 | 46749 | TACCTACTAAAAGATGTGAA | 85 | 458 |
| 1100711 | 2205 | 2224 | 46731 | 46750 | ATACCTACTAAAAGATGTGA | 74 | 459 |
| 1100712 | 2206 | 2225 | 46732 | 46751 | TATACCTACTAAAAGATGTG | 77 | 460 |
| 1100713 | 2207 | 2226 | 46733 | 46752 | CTATACCTACTAAAAGATGT | 103 | 461 |
| 1100714 | 2208 | 2227 | 46734 | 46753 | GCTATACCTACTAAAAGATG | 55 | 462 |
| 1100715 | 2209 | 2228 | 46735 | 46754 | AGCTATACCTACTAAAAGAT | 63 | 463 |
| 1100716 | 2210 | 2229 | 46736 | 46755 | AAGCTATACCTACTAAAAGA | 73 | 464 |
| 1100718 | 2212 | 2231 | 46738 | 46757 | ACAAGCTATACCTACTAAAA | 60 | 465 |
| 1100720 | 2214 | 2233 | 46740 | 46759 | TGACAAGCTATACCTACTAA | 45 | 466 |
| 1100721 | 2216 | 2235 | 46742 | 46761 | TTTGACAAGCTATACCTACT | 57 | 467 |
| 1100722 | 2225 | 2244 | 46751 | 46770 | ATCACCATCTTTGACAAGCT | 30 | 468 |
| 1100723 | 2229 | 2248 | 46755 | 46774 | CCAGATCACCATCTTTGACA | 22 | 469 |
| 1100724 | 2231 | 2250 | 46757 | 46776 | TTCCAGATCACCATCTTTGA | 38 | 470 |
| 1100725 | 2232 | 2251 | 46758 | 46777 | GTTCCAGATCACCATCTTTG | 8 | 471 |
| 1100726 | 2233 | 2252 | 46759 | 46778 | TGTTCCAGATCACCATCTTT | 39 | 472 |
| 1100727 | 2234 | 2253 | 46760 | 46779 | ATGTTCCAGATCACCATCTT | 38 | 473 |
| 1100728 | 2236 | 2255 | 46762 | 46781 | TCATGTTCCAGATCACCATC | 83 | 474 |
| 1100729 | 2237 | 2256 | 46763 | 46782 | TTCATGTTCCAGATCACCAT | 16 | 475 |
| 1100730 | 2238 | 2257 | 46764 | 46783 | TTTCATGTTCCAGATCACCA | 15 | 476 |
| 1100731 | 2239 | 2258 | 46765 | 46784 | TTTTCATGTTCCAGATCACC | 22 | 477 |
| 1100732 | 2244 | 2263 | 46770 | 46789 | AATTATTTTCATGTTCCAGA | 12 | 478 |
| 1100733 | 2251 | 2270 | 46777 | 46796 | ATTAGTAAATTATTTTCATG | 76 | 479 |
| 1100734 | 2261 | 2280 | 46787 | 46806 | ACATATTTTCATTAGTAAAT | 131 | 480 |
| 1100735 | 2262 | 2281 | 46788 | 46807 | AACATATTTTCATTAGTAAA | 82 | 481 |
| 1100736 | 2273 | 2292 | 46799 | 46818 | GTATAAATTTAAACATATTT | 82 | 482 |
| 1100737 | 2276 | 2295 | 46802 | 46821 | ACAGTATAAATTTAAACATA | 101 | 483 |
| 1100738 | 2277 | 2296 | 46803 | 46822 | CACAGTATAAATTTAAACAT | 86 | 484 |
| 1100739 | 2278 | 2297 | 46804 | 46823 | TCACAGTATAAATTTAAACA | 96 | 485 |
| 1100740 | 2279 | 2298 | 46805 | 46824 | ATCACAGTATAAATTTAAAC | 116 | 486 |
| 1100741 | 2280 | 2299 | 46806 | 46825 | AATCACAGTATAAATTTAAA | 79 | 487 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100742 | 2282 | 2301 | 46808 | 46827 | CAAATCACAGTATAAATTTA | 92 | 488 |
| 1100743 | 2288 | 2307 | 46814 | 46833 | AAGTGTCAAATCACAGTATA | 58 | 489 |
| 1100744 | 2291 | 2310 | 46817 | 46836 | TGCAAGTGTCAAATCACAGT | 28 | 490 |
| 1100745 | 2305 | 2324 | 46831 | 46850 | CTATCTAAACATGATGCAAG | 63 | 491 |
| 1100746 | 2306 | 2325 | 46832 | 46851 | GCTATCTAAACATGATGCAA | 62 | 492 |
| 1100747 | 2307 | 2326 | 46833 | 46852 | AGCTATCTAAACATGATGCA | 87 | 493 |
| 1100748 | 2309 | 2328 | 46835 | 46854 | TAAGCTATCTAAACATGATG | 77 | 494 |
| 1100749 | 2310 | 2329 | 46836 | 46855 | TTAAGCTATCTAAACATGAT | 89 | 495 |
| 1100750 | 2311 | 2330 | 46837 | 46856 | CTTAAGCTATCTAAACATGA | 81 | 496 |
| 1100751 | 2312 | 2331 | 46838 | 46857 | TCTTAAGCTATCTAAACATG | 52 | 497 |
| 1100752 | 2314 | 2333 | 46840 | 46859 | GTTCTTAAGCTATCTAAACA | 63 | 498 |
| 1100754 | 2346 | 2365 | 46872 | 46891 | TTATAGATCCACTAAGTACT | 71 | 499 |
| 1100756 | 2355 | 2374 | 46881 | 46900 | CTTTCTTATTTATAGATCCA | 22 | 500 |
| 1100757 | 2357 | 2376 | 46883 | 46902 | GACTTTCTTATTTATAGATC | 32 | 501 |
| 1100758 | 2371 | 2390 | 46897 | 46916 | TTATCAAAACTATGGACTTT | 89 | 502 |
| 1100759 | 2372 | 2391 | 46898 | 46917 | TTTATCAAAACTATGGACTT | 61 | 503 |
| 1100760 | 2373 | 2392 | 46899 | 46918 | ATTTATCAAAACTATGGACT | 56 | 504 |
| 1100761 | 2375 | 2394 | 46901 | 46920 | ATATTTATCAAAACTATGGA | 87 | 505 |
| 1100762 | 2376 | 2395 | 46902 | 46921 | AATATTTATCAAAACTATGG | 75 | 506 |
| 1100763 | 2384 | 2403 | 46910 | 46929 | TTAAAGAGAATATTTATCAA | 123 | 507 |
| 1100764 | 2386 | 2405 | 46912 | 46931 | AATTAAAGAGAATATTTATC | 107 | 508 |
| 1100765 | 2392 | 2411 | 46918 | 46937 | CATCTCAATTAAAGAGAATA | 172 | 509 |
| 1100766 | 2395 | 2414 | 46921 | 46940 | GTACATCTCAATTAAAGAGA | 36 | 510 |
| 1100767 | 2422 | 2441 | 46948 | 46967 | TCCTATTGACCCAGCAAGAA | 38 | 511 |
| 1100768 | 2426 | 2445 | 46952 | 46971 | ACTATCCTATTGACCCAGCA | 24 | 512 |
| 1100769 | 2430 | 2449 | 46956 | 46975 | TGATACTATCCTATTGACCC | 25 | 513 |
| 1100770 | 2444 | 2463 | 46970 | 46989 | GGTTTTCACCAAAATGATAC | 50 | 514 |
| 1100771 | 2463 | 2482 | 46989 | 47008 | ACATCAATTTCAGAGACATG | 33 | 515 |
| 1100772 | 2464 | 2483 | 46990 | 47009 | AACATCAATTTCAGAGACAT | 24 | 516 |
| 1100773 | 2465 | 2484 | 46991 | 47010 | AAACATCAATTTCAGAGACA | 48 | 517 |
| 1100774 | 2472 | 2491 | 46998 | 47017 | GAAACTAAAACATCAATTTC | 104 | 518 |
| 1100775 | 2475 | 2494 | 47001 | 47020 | ACTGAAACTAAAACATCAAT | 114 | 519 |
| 1100776 | 2516 | 2535 | 47042 | 47061 | AAAGAGCTTCAAAAGGAGAT | 55 | 520 |
| 1100777 | 2525 | 2544 | 47051 | 47070 | CAACATTCAAAAGAGCTTCA | 40 | 521 |
| 1100778 | 2526 | 2545 | 47052 | 47071 | TCAACATTCAAAAGAGCTTC | 53 | 522 |
| 1100779 | 2527 | 2546 | 47053 | 47072 | TTCAACATTCAAAAGAGCTT | 65 | 523 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100780 | 2530 | 2549 | 47056 | 47075 | CAATTCAACATTCAAAAGAG | 64 | 524 |
| 1100781 | 2531 | 2550 | 47057 | 47076 | ACAATTCAACATTCAAAAGA | 97 | 525 |
| 1100782 | 2532 | 2551 | 47058 | 47077 | AACAATTCAACATTCAAAAG | 68 | 526 |
| 1100783 | 2533 | 2552 | 47059 | 47078 | GAACAATTCAACATTCAAAA | 39 | 527 |
| 1100784 | 2534 | 2553 | 47060 | 47079 | TGAACAATTCAACATTCAAA | 53 | 528 |
| 1100785 | 2535 | 2554 | 47061 | 47080 | ATGAACAATTCAACATTCAA | 57 | 529 |
| 1100786 | 2536 | 2555 | 47062 | 47081 | TATGAACAATTCAACATTCA | 67 | 530 |
| 1100787 | 2537 | 2556 | 47063 | 47082 | TTATGAACAATTCAACATTC | 50 | 531 |
| 1100788 | 2539 | 2558 | 47065 | 47084 | GCTTATGAACAATTCAACAT | 21 | 532 |
| 1100790 | 2543 | 2562 | 47069 | 47088 | TTTAGCTTATGAACAATTCA | 60 | 533 |
| 1100792 | 2553 | 2572 | 47079 | 47098 | TTTCTTGGATTTTAGCTTAT | 32 | 534 |
| 1100793 | 2561 | 2580 | 47087 | 47106 | AGCTGAAATTTCTTGGATTT | 48 | 535 |
| 1100794 | 2562 | 2581 | 47088 | 47107 | CAGCTGAAATTTCTTGGATT | 54 | 536 |
| 1100795 | 2563 | 2582 | 47089 | 47108 | TCAGCTGAAATTTCTTGGAT | 38 | 537 |
| 1100796 | 2564 | 2583 | 47090 | 47109 | GTCAGCTGAAATTTCTTGGA | 17 | 538 |
| 1100797 | 2566 | 2585 | 47092 | 47111 | TTGTCAGCTGAAATTTCTTG | 30 | 539 |
| 1100798 | 2568 | 2587 | 47094 | 47113 | AGTTGTCAGCTGAAATTTCT | 33 | 540 |
| 1100799 | 2569 | 2588 | 47095 | 47114 | AAGTTGTCAGCTGAAATTTC | 34 | 541 |
| 1100800 | 2570 | 2589 | 47096 | 47115 | GAAGTTGTCAGCTGAAATTT | 84 | 542 |
| 1100801 | 2571 | 2590 | 47097 | 47116 | CGAAGTTGTCAGCTGAAATT | 23 | 543 |
| 1100802 | 2572 | 2591 | 47098 | 47117 | TCGAAGTTGTCAGCTGAAAT | 16 | 544 |
| 1100803 | 2573 | 2592 | 47099 | 47118 | TTCGAAGTTGTCAGCTGAAA | 24 | 545 |
| 1100804 | 2574 | 2593 | 47100 | 47119 | TTTCGAAGTTGTCAGCTGAA | 26 | 546 |
| 1100805 | 2576 | 2595 | 47102 | 47121 | ATTTTCGAAGTTGTCAGCTG | 42 | 547 |
| 1100806 | 2583 | 2602 | 47109 | 47128 | TATTATAATTTTCGAAGTTG | 53 | 548 |
| 1100807 | 2585 | 2604 | 47111 | 47130 | CATATTATAATTTTCGAAGT | 71 | 549 |
| 1100808 | 2590 | 2609 | 47116 | 47135 | TATACCATATTATAATTTTC | 56 | 550 |
| 1100809 | 2595 | 2614 | 47121 | 47140 | GGCAATATACCATATTATAA | 14 | 551 |
| 1100810 | 2597 | 2616 | 47123 | 47142 | AGGGCAATATACCATATTAT | 17 | 552 |
| 1100811 | 2598 | 2617 | 47124 | 47143 | GAGGGCAATATACCATATTA | 25 | 553 |
| 1100812 | 2642 | 2661 | 47168 | 47187 | ATCAAAAAACTTTCCCTGAT | 79 | 554 |
| 1100813 | 2643 | 2662 | 47169 | 47188 | GATCAAAAAACTTTCCCTGA | 70 | 555 |
| 1100814 | 2644 | 2663 | 47170 | 47189 | AGATCAAAAAACTTTCCCTG | 58 | 556 |
| 1100815 | 2646 | 2665 | 47172 | 47191 | CTAGATCAAAAAACTTTCCC | 75 | 557 |
| 1100816 | 2647 | 2666 | 47173 | 47192 | CCTAGATCAAAAAACTTTCC | 58 | 558 |
| 1100817 | 2648 | 2667 | 47174 | 47193 | TCCTAGATCAAAAAACTTTC | 91 | 559 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100818 | 2649 | 2668 | 47175 | 47194 | ATCCTAGATCAAAAAACTTT | 62 | 560 |
| 1100819 | 2650 | 2669 | 47176 | 47195 | AATCCTAGATCAAAAAACTT | 62 | 561 |
| 1100820 | 2651 | 2670 | 47177 | 47196 | AAATCCTAGATCAAAAAACT | 92 | 562 |
| 1100821 | 2652 | 2671 | 47178 | 47197 | TAAATCCTAGATCAAAAAAC | 75 | 563 |
| 1100822 | 2656 | 2675 | 47182 | 47201 | GCAATAAATCCTAGATCAAA | 50 | 564 |
| 1100823 | 2657 | 2676 | 47183 | 47202 | AGCAATAAATCCTAGATCAA | 51 | 565 |
| 1100824 | 2658 | 2677 | 47184 | 47203 | TAGCAATAAATCCTAGATCA | 66 | 566 |
| 1100826 | 2660 | 2679 | 47186 | 47205 | GTTAGCAATAAATCCTAGAT | 29 | 567 |
| 1100828 | 2700 | 2719 | 47226 | 47245 | AATCATAAATAAAAGATATT | 87 | 568 |
| 1100829 | 2701 | 2720 | 47227 | 47246 | TAATCATAAATAAAAGATAT | 98 | 569 |
| 1100830 | 2712 | 2731 | 47238 | 47257 | AAGCTATTTTATAATCATAA | 72 | 570 |
| 1100831 | 2714 | 2733 | 47240 | 47259 | AAAAGCTATTTTATAATCAT | 78 | 571 |
| 1100832 | 2739 | 2758 | 47265 | 47284 | CTTAAAAAATCTGTTATATC | 78 | 572 |
| 1100833 | 2741 | 2760 | 47267 | 47286 | GACTTAAAAAATCTGTTATA | 83 | 573 |
| 1100834 | 2742 | 2761 | 47268 | 47287 | TGACTTAAAAAATCTGTTAT | 88 | 574 |
| 1100835 | 2743 | 2762 | 47269 | 47288 | ATGACTTAAAAAATCTGTTA | 67 | 575 |
| 1100836 | 2744 | 2763 | 47270 | 47289 | AATGACTTAAAAAATCTGTT | 77 | 576 |
| 1100837 | 2745 | 2764 | 47271 | 47290 | TAATGACTTAAAAAATCTGT | 83 | 577 |
| 1100838 | 2753 | 2772 | 47279 | 47298 | GCACAAAATAATGACTTAAA | 38 | 578 |
| 1100839 | 2754 | 2773 | 47280 | 47299 | GGCACAAAATAATGACTTAA | 8 | 579 |
| 1100840 | 2755 | 2774 | 47281 | 47300 | TGGCACAAAATAATGACTTA | 28 | 580 |
| 1100841 | 2756 | 2775 | 47282 | 47301 | TTGGCACAAAATAATGACTT | 42 | 581 |
| 1100842 | 2758 | 2777 | 47284 | 47303 | GATTGGCACAAAATAATGAC | 39 | 582 |
| 1100843 | 2778 | 2797 | 47304 | 47323 | AAGGGAAACTTCAGAAAACT | 41 | 583 |
| 1100844 | 2779 | 2798 | 47305 | 47324 | TAAGGGAAACTTCAGAAAAC | 74 | 584 |
| 1100845 | 2780 | 2799 | 47306 | 47325 | GTAAGGGAAACTTCAGAAAA | 42 | 585 |
| 1100846 | 2781 | 2800 | 47307 | 47326 | TGTAAGGGAAACTTCAGAAA | 24 | 586 |
| 1100847 | 2810 | 2829 | 47336 | 47355 | TTAGATTTTAAAATAAAGCT | 95 | 587 |
| 1100848 | 2830 | 2849 | 47356 | 47375 | TTTAACTATTAAAAGAAACT | 91 | 588 |
| 1100849 | 2840 | 2859 | 47366 | 47385 | CTGAAACATTTTTAACTATT | 60 | 589 |
| 1100850 | 2849 | 2868 | 47375 | 47394 | ATAATTCTTCTGAAACATTT | 59 | 590 |
| 1100851 | 2851 | 2870 | 47377 | 47396 | TTATAATTCTTCTGAAACAT | 58 | 591 |
| 1100852 | 2852 | 2871 | 47378 | 47397 | TTTATAATTCTTCTGAAACA | 79 | 592 |
| 1100853 | 2853 | 2872 | 47379 | 47398 | TTTTATAATTCTTCTGAAAC | 112 | 593 |
| 1100854 | 2854 | 2873 | 47380 | 47399 | GTTTTATAATTCTTCTGAAA | 58 | 594 |
| 1100855 | 2855 | 2874 | 47381 | 47400 | AGTTTTATAATTCTTCTGAA | 61 | 595 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100856 | 2856 | 2875 | 47382 | 47401 | AAGTTTTATAATTCTTCTGA | 59 | 596 |
| 1100857 | 2858 | 2877 | 47384 | 47403 | TAAAGTTTTATAATTCTTCT | 87 | 597 |
| 1100858 | 2859 | 2878 | 47385 | 47404 | TTAAAGTTTTATAATTCTTC | 79 | 598 |
| 1100859 | 2862 | 2881 | 47388 | 47407 | GTTTTAAAGTTTTATAATTC | 96 | 599 |
| 1100860 | 2867 | 2886 | 47393 | 47412 | TTGCAGTTTTAAAGTTTTAT | 82 | 600 |
| 1100862 | 2908 | 2927 | 47434 | 47453 | TTTTTAAATCTTGAGGGAGT | 51 | 601 |
| 1100864 | 2912 | 2931 | 47438 | 47457 | TAGCTTTTTAAATCTTGAGG | 11 | 602 |
| 1100865 | 2913 | 2932 | 47439 | 47458 | TTAGCTTTTTAAATCTTGAG | 11 | 603 |
| 1100866 | 2914 | 2933 | 47440 | 47459 | TTTAGCTTTTTAAATCTTGA | 60 | 604 |
| 1100867 | 2915 | 2934 | 47441 | 47460 | ATTTAGCTTTTTAAATCTTG | 84 | 605 |
| 1100868 | 2916 | 2935 | 47442 | 47461 | TATTTAGCTTTTTAAATCTT | 96 | 606 |
| 1100869 | 2924 | 2943 | 47450 | 47469 | TCTTAAAATATTTAGCTTTT | 87 | 607 |
| 1100870 | 2925 | 2944 | 47451 | 47470 | GTCTTAAAATATTTAGCTTT | 45 | 608 |
| 1100871 | 2926 | 2945 | 47452 | 47471 | AGTCTTAAAATATTTAGCTT | 58 | 609 |
| 1100872 | 2927 | 2946 | 47453 | 47472 | CAGTCTTAAAATATTTAGCT | 85 | 610 |
| 1100873 | 2928 | 2947 | 47454 | 47473 | TCAGTCTTAAAATATTTAGC | 7 | 611 |
| 1100874 | 2929 | 2948 | 47455 | 47474 | TTCAGTCTTAAAATATTTAG | 78 | 612 |
| 1100875 | 2930 | 2949 | 47456 | 47475 | GTTCAGTCTTAAAATATTTA | 26 | 613 |
| 1100876 | 2932 | 2951 | 47458 | 47477 | ATGTTCAGTCTTAAAATATT | 47 | 614 |
| 1100877 | 2935 | 2954 | 47461 | 47480 | TAAATGTTCAGTCTTAAAAT | 98 | 615 |
| 1100878 | 2936 | 2955 | 47462 | 47481 | ATAAATGTTCAGTCTTAAAA | 94 | 616 |
| 1100879 | 2948 | 2967 | 47474 | 47493 | GTAATAATTAACATAAATGT | 95 | 617 |
| 1100880 | 2951 | 2970 | 47477 | 47496 | CTGGTAATAATTAACATAAA | 110 | 618 |
| 1100881 | 2952 | 2971 | 47478 | 47497 | ACTGGTAATAATTAACATAA | 54 | 619 |
| 1100882 | 2974 | 2993 | 47500 | 47519 | CCATGGAAAATATGACAAAC | 44 | 620 |
| 1100883 | 2982 | 3001 | 47508 | 47527 | ACAAATATCCATGGAAAATA | 76 | 621 |
| 1100884 | 2983 | 3002 | 47509 | 47528 | AACAAATATCCATGGAAAAT | 70 | 622 |
| 1100885 | 2984 | 3003 | 47510 | 47529 | GAACAAATATCCATGGAAAA | 43 | 623 |
| 1100886 | 2985 | 3004 | 47511 | 47530 | TGAACAAATATCCATGGAAA | 49 | 624 |
| 1100887 | 2987 | 3006 | 47513 | 47532 | AATGAACAAATATCCATGGA | 50 | 625 |
| 1100888 | 2988 | 3007 | 47514 | 47533 | TAATGAACAAATATCCATGG | 43 | 626 |
| 1100889 | 2989 | 3008 | 47515 | 47534 | GTAATGAACAAATATCCATG | 27 | 627 |
| 1100890 | 2990 | 3009 | 47516 | 47535 | GGTAATGAACAAATATCCAT | 52 | 628 |
| 1100891 | 2991 | 3010 | 47517 | 47536 | AGGTAATGAACAAATATCCA | 40 | 629 |
| 1100892 | 2996 | 3015 | 47522 | 47541 | GAAAAAGGTAATGAACAAAT | 84 | 630 |
| 1100893 | 3031 | 3050 | 47557 | 47576 | CAAGTGTATGAAAAGTTTAA | 75 | 631 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100894 | 3038 | 3057 | 47564 | 47583 | ATCAATTCAAGTGTATGAAA | 83 | 632 |
| 1100895 | 3040 | 3059 | 47566 | 47585 | TCATCAATTCAAGTGTATGA | 35 | 633 |
| 1100896 | 3041 | 3060 | 47567 | 47586 | CTCATCAATTCAAGTGTATG | 42 | 634 |
| 1100898 | 3043 | 3062 | 47569 | 47588 | AGCTCATCAATTCAAGTGTA | 18 | 635 |
| 1100900 | 3045 | 3064 | 47571 | 47590 | GTAGCTCATCAATTCAAGTG | 16 | 636 |
| 1100901 | 3046 | 3065 | 47572 | 47591 | GGTAGCTCATCAATTCAAGT | 17 | 637 |
| 1100902 | 3047 | 3066 | 47573 | 47592 | AGGTAGCTCATCAATTCAAG | 20 | 638 |
| 1100903 | 3048 | 3067 | 47574 | 47593 | TAGGTAGCTCATCAATTCAA | 16 | 639 |
| 1100904 | 3049 | 3068 | 47575 | 47594 | TTAGGTAGCTCATCAATTCA | 33 | 640 |
| 1100905 | 3051 | 3070 | 47577 | 47596 | TATTAGGTAGCTCATCAATT | 36 | 641 |
| 1100906 | 3060 | 3079 | 47586 | 47605 | TCATTTTTATATTAGGTAGC | 15 | 642 |
| 1100907 | 3061 | 3080 | 47587 | 47606 | CTCATTTTTATATTAGGTAG | 11 | 643 |
| 1100908 | 3062 | 3081 | 47588 | 47607 | TCTCATTTTTATATTAGGTA | 112 | 644 |
| 1100909 | 3069 | 3088 | 47595 | 47614 | TTGGTTTTCTCATTTTTATA | 23 | 645 |
| 1100910 | 3070 | 3089 | 47596 | 47615 | ATTGGTTTTCTCATTTTTAT | 21 | 646 |
| 1100911 | 3071 | 3090 | 47597 | 47616 | TATTGGTTTTCTCATTTTTA | 15 | 647 |
| 1100912 | 3072 | 3091 | 47598 | 47617 | ATATTGGTTTTCTCATTTTT | 34 | 648 |
| 1100913 | 3073 | 3092 | 47599 | 47618 | CATATTGGTTTTCTCATTTT | 24 | 649 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 78 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 4 | 45 |
| 1100914 | 3074 | 3093 | 47600 | 47619 | GCATATTGGTTTTCTCATTT | 5 | 45 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 9 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 4 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 5 | 45 |
| 1100915 | 3075 | 3094 | 47601 | 47620 | TGCATATTGGTTTTCTCATT | 8 | 650 |
| 1100916 | 3076 | 3095 | 47602 | 47621 | ATGCATATTGGTTTTCTCAT | 10 | 651 |
| 1100917 | 3077 | 3096 | 47603 | 47622 | AATGCATATTGGTTTTCTCA | 8 | 652 |
| 1100918 | 3079 | 3098 | 47605 | 47624 | AAAATGCATATTGGTTTTCT | 22 | 653 |
| 1100919 | 3116 | 3135 | 47642 | 47661 | TATATATGAACTTTATAAAC | 74 | 654 |
| 1100920 | 3119 | 3138 | 47645 | 47664 | GGGTATATATGAACTTTATA | 8 | 655 |
| 1100921 | 3122 | 3141 | 47648 | 47667 | CTAGGGTATATATGAACTTT | 21 | 656 |
| 1100922 | 3123 | 3142 | 47649 | 47668 | ACTAGGGTATATATGAACTT | 24 | 657 |
| 1100923 | 3124 | 3143 | 47650 | 47669 | AACTAGGGTATATATGAACT | 24 | 658 |
| 1100924 | 3133 | 3152 | 47659 | 47678 | AAGTGCTTTAACTAGGGTAT | 16 | 659 |
| 1100925 | 3134 | 3153 | 47660 | 47679 | TAAGTGCTTTAACTAGGGTA | 19 | 660 |
| 1100926 | 3135 | 3154 | 47661 | 47680 | TTAAGTGCTTTAACTAGGGT | 55 | 661 |
| 1100927 | 3140 | 3159 | 47666 | 47685 | TTTTCTTAAGTGCTTTAACT | 53 | 662 |
| 1100928 | 3146 | 3165 | 47672 | 47691 | GCCATATTTTCTTAAGTGCT | 18 | 663 |
| 1100929 | 3162 | 3181 | 47688 | 47707 | ACTAAAAGTCAAACATGCCA | 43 | 664 |
| 1100930 | 3164 | 3183 | 47690 | 47709 | GAACTAAAAGTCAAACATGC | 44 | 665 |
| 1100931 | 3507 | 3526 | 48033 | 48052 | GCTCTGCTTTAAAAACTCTC | 89 | 666 |
| 1100932 | 3536 | 3555 | 48062 | 48081 | CACATTCAAACGCATCCAGT | 49 | 667 |
| 1100933 | 3537 | 3556 | 48063 | 48082 | ACACATTCAAACGCATCCAG | 39 | 668 |
| 1100935 | 3540 | 3559 | 48066 | 48085 | CAAACACATTCAAACGCATC | 85 | 669 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100937 | 3542 | 3561 | 48068 | 48087 | CACAAACACATTCAAACGCA | 69 | 670 |
| 1100938 | 3544 | 3563 | 48070 | 48089 | TACACAAACACATTCAAACG | 76 | 671 |
| 1100939 | 3545 | 3564 | 48071 | 48090 | CTACACAAACACATTCAAAC | 57 | 672 |
| 1100940 | 3546 | 3565 | 48072 | 48091 | ACTACACAAACACATTCAAA | 82 | 673 |
| 1100941 | 3549 | 3568 | 48075 | 48094 | CAAACTACACAAACACATTC | 76 | 674 |
| 1100942 | 3550 | 3569 | 48076 | 48095 | ACAAACTACACAAACACATT | 95 | 675 |
| 1100943 | 3551 | 3570 | 48077 | 48096 | AACAAACTACACAAACACAT | 66 | 676 |
| 1100944 | 3554 | 3573 | 48080 | 48099 | CACAACAAACTACACAAACA | 65 | 677 |
| 1100945 | 3555 | 3574 | 48081 | 48100 | TCACAACAAACTACACAAAC | 92 | 678 |
| 1100946 | 3556 | 3575 | 48082 | 48101 | TTCACAACAAACTACACAAA | 88 | 679 |
| 1100947 | 3558 | 3577 | 48084 | 48103 | ATTTCACAACAAACTACACA | 78 | 680 |
| 1100948 | 3559 | 3578 | 48085 | 48104 | AATTTCACAACAAACTACAC | 66 | 681 |
| 1100949 | 3560 | 3579 | 48086 | 48105 | CAATTTCACAACAAACTACA | 93 | 682 |
| 1100950 | 3563 | 3582 | 48089 | 48108 | TAACAATTTCACAACAAACT | 89 | 683 |
| 1100951 | 3564 | 3583 | 48090 | 48109 | GTAACAATTTCACAACAAAC | 38 | 684 |
| 1100952 | 3565 | 3584 | 48091 | 48110 | TGTAACAATTTCACAACAAA | 52 | 685 |
| 1100953 | 3566 | 3585 | 48092 | 48111 | ATGTAACAATTTCACAACAA | 35 | 686 |
| 1100954 | 3567 | 3586 | 48093 | 48112 | AATGTAACAATTTCACAACA | 61 | 687 |
| 1100955 | 3568 | 3587 | 48094 | 48113 | AAATGTAACAATTTCACAAC | 73 | 688 |
| 1100956 | 3569 | 3588 | 48095 | 48114 | TAAATGTAACAATTTCACAA | 104 | 689 |
| 1100957 | 3570 | 3589 | 48096 | 48115 | CTAAATGTAACAATTTCACA | 87 | 690 |
| 1100958 | 3571 | 3590 | 48097 | 48116 | GCTAAATGTAACAATTTCAC | 46 | 691 |
| 1100959 | 3576 | 3595 | 48102 | 48121 | TGCCTGCTAAATGTAACAAT | 66 | 692 |
| 1100960 | 3582 | 3601 | 48108 | 48127 | TGGATCTGCCTGCTAAATGT | 42 | 693 |
| 1100961 | 3616 | 3635 | 48142 | 48161 | CAACCCCACCAAGATGACAG | 68 | 694 |
| 1100962 | 3621 | 3640 | 48147 | 48166 | TAAGCCAACCCCACCAAGAT | 88 | 695 |
| 1100963 | 3622 | 3641 | 48148 | 48167 | TTAAGCCAACCCCACCAAGA | 53 | 696 |
| 1100964 | 3626 | 3645 | 48152 | 48171 | AAATTTAAGCCAACCCCACC | 83 | 697 |
| 1100965 | 3627 | 3646 | 48153 | 48172 | TAAATTTAAGCCAACCCCAC | 134 | 698 |
| 1100966 | 3633 | 3652 | 48159 | 48178 | GTCAATTAAATTTAAGCCAA | 41 | 699 |
| 1100967 | 3636 | 3655 | 48162 | 48181 | ACAGTCAATTAAATTTAAGC | 72 | 700 |
| 1100968 | 3644 | 3663 | 48170 | 48189 | GAATCTAAACAGTCAATTAA | 75 | 701 |
| 1100969 | 3648 | 3667 | 48174 | 48193 | AATGGAATCTAAACAGTCAA | 78 | 702 |
| 1100971 | 3668 | 3687 | 48194 | 48213 | TACTGGCCAATCAATTAAGA | 73 | 703 |
| 1100973 | 3672 | 3691 | 48198 | 48217 | TTCATACTGGCCAATCAATT | 60 | 704 |
| 1100974 | 3674 | 3693 | 48200 | 48219 | TTTTCATACTGGCCAATCAA | 64 | 705 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100975 | 3676 | 3695 | 48202 | 48221 | TCTTTTCATACTGGCCAATC | 71 | 706 |
| 1100976 | 3677 | 3696 | 48203 | 48222 | ATCTTTTCATACTGGCCAAT | 52 | 707 |
| 1100977 | 3678 | 3697 | 48204 | 48223 | CATCTTTTCATACTGGCCAA | 50 | 708 |
| 1100978 | 3679 | 3698 | 48205 | 48224 | GCATCTTTTCATACTGGCCA | 35 | 709 |
| 1100979 | 3680 | 3699 | 48206 | 48225 | GGCATCTTTTCATACTGGCC | 29 | 710 |
| 1100980 | 3681 | 3700 | 48207 | 48226 | TGGCATCTTTTCATACTGGC | 14 | 711 |
| 1100981 | 3682 | 3701 | 48208 | 48227 | CTGGCATCTTTTCATACTGG | 104 | 712 |
| 1100982 | 3684 | 3703 | 48210 | 48229 | CACTGGCATCTTTTCATACT | 28 | 713 |
| 1100983 | 3699 | 3718 | 48225 | 48244 | TACTATGGTTACTTGCACTG | 35 | 714 |
| 1100984 | 3730 | 3749 | 48256 | 48275 | TATAGCTTTGAATAATTTTT | 121 | 715 |
| 1100985 | 3740 | 3759 | 48266 | 48285 | ATGTATAAACTATAGCTTTG | 37 | 716 |
| 1100986 | 3742 | 3761 | 48268 | 48287 | TGATGTATAAACTATAGCTT | 53 | 717 |
| 1100987 | 3747 | 3766 | 48273 | 48292 | GTACCTGATGTATAAACTAT | 51 | 718 |
| 1100988 | 3749 | 3768 | 48275 | 48294 | CAGTACCTGATGTATAAACT | 21 | 719 |
| 1100989 | 3750 | 3769 | 48276 | 48295 | GCAGTACCTGATGTATAAAC | 11 | 720 |
| 1100990 | 3751 | 3770 | 48277 | 48296 | GGCAGTACCTGATGTATAAA | 10 | 721 |
| 1100991 | 3752 | 3771 | 48278 | 48297 | TGGCAGTACCTGATGTATAA | 10 | 722 |
| 1100992 | 3753 | 3772 | 48279 | 48298 | ATGGCAGTACCTGATGTATA | 16 | 723 |
| 1100993 | 3754 | 3773 | 48280 | 48299 | AATGGCAGTACCTGATGTAT | 48 | 724 |
| 1100994 | 3755 | 3774 | 48281 | 48300 | AAATGGCAGTACCTGATGTA | 40 | 725 |
| 1100995 | 3757 | 3776 | 48283 | 48302 | GTAAATGGCAGTACCTGATG | 15 | 726 |
| 1100996 | 3764 | 3783 | 48290 | 48309 | GTTTACAGTAAATGGCAGTA | 18 | 727 |
| 1100997 | 3766 | 3785 | 48292 | 48311 | TGGTTTACAGTAAATGGCAG | 16 | 728 |
| 1100998 | 3768 | 3787 | 48294 | 48313 | GGTGGTTTACAGTAAATGGC | 25 | 729 |
| 1100999 | 3769 | 3788 | 48295 | 48314 | AGGTGGTTTACAGTAAATGG | 17 | 730 |
| 1101000 | 3771 | 3790 | 48297 | 48316 | GCAGGTGGTTTACAGTAAAT | 13 | 731 |
| 1101001 | 3782 | 3801 | 48308 | 48327 | CTGACTTTCTTGCAGGTGGT | 21 | 732 |
| 1101002 | 3785 | 3804 | 48311 | 48330 | TTCCTGACTTTCTTGCAGGT | 102 | 733 |
| 1101003 | 3786 | 3805 | 48312 | 48331 | GTTCCTGACTTTCTTGCAGG | 45 | 734 |
| 1101004 | 3788 | 3807 | 48314 | 48333 | TTGTTCCTGACTTTCTTGCA | 27 | 735 |
| 1101005 | 3791 | 3810 | 48317 | 48336 | TAGTTGTTCCTGACTTTCTT | 50 | 736 |
| 1101007 | 3793 | 3812 | 48319 | 48338 | TTTAGTTGTTCCTGACTTTC | 74 | 737 |
| 1101009 | 3838 | 3857 | 48364 | 48383 | AATGGAAATCTTTAATACAC | 64 | 738 |
| 1101010 | 3854 | 3873 | 48380 | 48399 | CCAATTAGTAAAACAAAATG | 104 | 739 |
| 1101011 | 3861 | 3880 | 48387 | 48406 | GATGTTCCCAATTAGTAAAA | 29 | 740 |
| 1101012 | 3863 | 3882 | 48389 | 48408 | AAGATGTTCCCAATTAGTAA | 29 | 741 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101013 | 3864 | 3883 | 48390 | 48409 | TAAGATGTTCCCAATTAGTA | 47 | 742 |
| 1101014 | 3870 | 3889 | 48396 | 48415 | AAACATTAAGATGTTCCCAA | 35 | 743 |
| 1101015 | 3871 | 3890 | 48397 | 48416 | TAAACATTAAGATGTTCCCA | 45 | 744 |
| 1101016 | 3873 | 3892 | 48399 | 48418 | ATTAAACATTAAGATGTTCC | 55 | 745 |
| 1101017 | 3874 | 3893 | 48400 | 48419 | TATTAAACATTAAGATGTTC | 90 | 746 |
| 1101018 | 3875 | 3894 | 48401 | 48420 | ATATTAAACATTAAGATGTT | 113 | 747 |
| 1101019 | 3877 | 3896 | 48403 | 48422 | AAATATTAAACATTAAGATG | 86 | 748 |
| 1101020 | 3878 | 3897 | 48404 | 48423 | TAAATATTAAACATTAAGAT | 90 | 749 |
| 1101021 | 3884 | 3903 | 48410 | 48429 | ATAGTTTAAATATTAAACAT | 99 | 750 |
| 1101022 | 3886 | 3905 | 48412 | 48431 | CAATAGTTTAAATATTAAAC | 119 | 751 |
| 1101023 | 3887 | 3906 | 48413 | 48432 | CCAATAGTTTAAATATTAAA | 111 | 752 |
| 1101024 | 3888 | 3907 | 48414 | 48433 | ACCAATAGTTTAAATATTAA | 98 | 753 |
| 1101025 | 3890 | 3909 | 48416 | 48435 | ATACCAATAGTTTAAATATT | 110 | 754 |
| 1101026 | 3896 | 3915 | 48422 | 48441 | AAAATGATACCAATAGTTTA | 78 | 755 |
| 1101027 | 3897 | 3916 | 48423 | 48442 | AAAAATGATACCAATAGTTT | 96 | 756 |
| 1101028 | 3898 | 3917 | 48424 | 48443 | GAAAAATGATACCAATAGTT | 67 | 757 |
| 1101029 | 3899 | 3918 | 48425 | 48444 | AGAAAAATGATACCAATAGT | 61 | 758 |
| 1101030 | 3900 | 3919 | 48426 | 48445 | TAGAAAAATGATACCAATAG | 61 | 759 |
| 1101031 | 3902 | 3921 | 48428 | 48447 | ATTAGAAAAATGATACCAAT | 75 | 760 |
| 1101032 | 3903 | 3922 | 48429 | 48448 | CATTAGAAAAATGATACCAA | 74 | 761 |
| 1101033 | 3905 | 3924 | 48431 | 48450 | TACATTAGAAAAATGATACC | 74 | 762 |
| 1101034 | 3906 | 3925 | 48432 | 48451 | ATACATTAGAAAAATGATAC | 119 | 763 |
| 1101035 | 3907 | 3926 | 48433 | 48452 | TATACATTAGAAAAATGATA | 94 | 764 |
| 1101036 | 3912 | 3931 | 48438 | 48457 | CAAATTATACATTAGAAAAA | 138 | 765 |
| 1101037 | 3913 | 3932 | 48439 | 48458 | ACAAATTATACATTAGAAAA | 83 | 766 |
| 1101038 | 3914 | 3933 | 48440 | 48459 | TACAAATTATACATTAGAAA | 70 | 767 |
| 1101039 | 3915 | 3934 | 48441 | 48460 | ATACAAATTATACATTAGAA | 113 | 768 |
| 1101040 | 3916 | 3935 | 48442 | 48461 | AATACAAATTATACATTAGA | 105 | 769 |
| 1101041 | 3917 | 3936 | 48443 | 48462 | TAATACAAATTATACATTAG | 85 | 770 |
| 1101043 | 3919 | 3938 | 48445 | 48464 | AGTAATACAAATTATACATT | 98 | 771 |
| 1101045 | 3922 | 3941 | 48448 | 48467 | CCCAGTAATACAAATTATAC | 74 | 772 |
| 1101046 | 3923 | 3942 | 48449 | 48468 | TCCCAGTAATACAAATTATA | 50 | 773 |
| 1101047 | 3924 | 3943 | 48450 | 48469 | ATCCCAGTAATACAAATTAT | 40 | 774 |
| 1101048 | 3925 | 3944 | 48451 | 48470 | GATCCCAGTAATACAAATTA | 47 | 775 |
| 1101049 | 3929 | 3948 | 48455 | 48474 | ACTTGATCCCAGTAATACAA | 21 | 776 |
| 1101050 | 3930 | 3949 | 48456 | 48475 | TACTTGATCCCAGTAATACA | 30 | 777 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101051 | 3931 | 3950 | 48457 | 48476 | ATACTTGATCCCAGTAATAC | 32 | 778 |
| 1101052 | 3932 | 3951 | 48458 | 48477 | CATACTTGATCCCAGTAATA | 29 | 779 |
| 1101053 | 3935 | 3954 | 48461 | 48480 | GTACATACTTGATCCCAGTA | 89 | 780 |
| 1101054 | 3937 | 3956 | 48463 | 48482 | CTGTACATACTTGATCCCAG | 15 | 781 |
| 1101055 | 3941 | 3960 | 48467 | 48486 | ACCACTGTACATACTTGATC | 32 | 782 |
| 1101056 | 3942 | 3961 | 48468 | 48487 | CACCACTGTACATACTTGAT | 45 | 783 |
| 1101057 | 3947 | 3966 | 48473 | 48492 | AGCATCACCACTGTACATAC | 15 | 784 |
| 1101058 | 3948 | 3967 | 48474 | 48493 | TAGCATCACCACTGTACATA | 23 | 785 |
| 1101059 | 3950 | 3969 | 48476 | 48495 | ACTAGCATCACCACTGTACA | 79 | 786 |
| 1101060 | 3951 | 3970 | 48477 | 48496 | TACTAGCATCACCACTGTAC | 74 | 787 |
| 1101061 | 3960 | 3979 | 48486 | 48505 | TTAAACTTCTACTAGCATCA | 56 | 788 |
| 1101062 | 3964 | 3983 | 48490 | 48509 | AGGCTTAAACTTCTACTAGC | 33 | 789 |
| 1101063 | 3968 | 3987 | 48494 | 48513 | TCCAAGGCTTAAACTTCTAC | 27 | 790 |
| 1101064 | 3977 | 3996 | 48503 | 48522 | AGTGGTATTTCCAAGGCTTA | 23 | 791 |
| 1101065 | 3978 | 3997 | 48504 | 48523 | AAGTGGTATTTCCAAGGCTT | 13 | 792 |
| 1101066 | 3979 | 3998 | 48505 | 48524 | AAAGTGGTATTTCCAAGGCT | 18 | 793 |
| 1101067 | 3989 | 4008 | 48515 | 48534 | TGAAAATATGAAAGTGGTAT | 30 | 794 |
| 1101068 | 3990 | 4009 | 48516 | 48535 | CTGAAAATATGAAAGTGGTA | 47 | 795 |
| 1101069 | 3993 | 4012 | 48519 | 48538 | CATCTGAAAATATGAAAGTG | 105 | 796 |
| 1101070 | 3994 | 4013 | 48520 | 48539 | ACATCTGAAAATATGAAAGT | 111 | 797 |
| 1101071 | 3995 | 4014 | 48521 | 48540 | GACATCTGAAAATATGAAAG | 25 | 798 |
| 1101072 | 3996 | 4015 | 48522 | 48541 | TGACATCTGAAAATATGAAA | 84 | 799 |
| 1101073 | 3997 | 4016 | 48523 | 48542 | ATGACATCTGAAAATATGAA | 48 | 800 |
| 1101074 | 4004 | 4023 | 48530 | 48549 | TAAATCCATGACATCTGAAA | 59 | 801 |
| 1101075 | 4007 | 4026 | 48533 | 48552 | CATTAAATCCATGACATCTG | 36 | 802 |
| 1101076 | 4008 | 4027 | 48534 | 48553 | TCATTAAATCCATGACATCT | 51 | 803 |
| 1101077 | 4009 | 4028 | 48535 | 48554 | CTCATTAAATCCATGACATC | 96 | 804 |
| 1101079 | 4011 | 4030 | 48537 | 48556 | TACTCATTAAATCCATGACA | 53 | 805 |
| 1101081 | 4013 | 4032 | 48539 | 48558 | ATTACTCATTAAATCCATGA | 60 | 806 |
| 1101082 | 4015 | 4034 | 48541 | 48560 | AAATTACTCATTAAATCCAT | 62 | 807 |
| 1101083 | 4016 | 4035 | 48542 | 48561 | TAAATTACTCATTAAATCCA | 102 | 808 |
| 1101084 | 4017 | 4036 | 48543 | 48562 | ATAAATTACTCATTAAATCC | 71 | 809 |
| 1101085 | 4018 | 4037 | 48544 | 48563 | CATAAATTACTCATTAAATC | 75 | 810 |
| 1101086 | 4019 | 4038 | 48545 | 48564 | ACATAAATTACTCATTAAAT | 126 | 811 |
| 1101087 | 4020 | 4039 | 48546 | 48565 | AACATAAATTACTCATTAAA | 81 | 812 |
| 1101088 | 4021 | 4040 | 48547 | 48566 | AAACATAAATTACTCATTAA | 78 | 813 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101089 | 4022 | 4041 | 48548 | 48567 | AAAACATAAATTACTCATTA | 103 | 814 |
| 1101090 | 4023 | 4042 | 48549 | 48568 | AAAAACATAAATTACTCATT | 98 | 815 |
| 1101091 | 4044 | 4063 | 48570 | 48589 | AGATTAACTATTCTGAATTT | 89 | 816 |
| 1101092 | 4045 | 4064 | 48571 | 48590 | GAGATTAACTATTCTGAATT | 46 | 817 |
| 1101093 | 4046 | 4065 | 48572 | 48591 | AGAGATTAACTATTCTGAAT | 47 | 818 |
| 1101094 | 4047 | 4066 | 48573 | 48592 | CAGAGATTAACTATTCTGAA | 57 | 819 |
| 1101095 | 4048 | 4067 | 48574 | 48593 | TCAGAGATTAACTATTCTGA | 74 | 820 |
| 1101096 | 4051 | 4070 | 48577 | 48596 | AGATCAGAGATTAACTATTC | 34 | 821 |
| 1101097 | 4052 | 4071 | 48578 | 48597 | TAGATCAGAGATTAACTATT | 42 | 822 |
| 1101098 | 4057 | 4076 | 48583 | 48602 | GGTTTTAGATCAGAGATTAA | 22 | 823 |
| 1101099 | 4058 | 4077 | 48584 | 48603 | TGGTTTTAGATCAGAGATTA | 17 | 824 |
| 1101100 | 4059 | 4078 | 48585 | 48604 | ATGGTTTTAGATCAGAGATT | 23 | 825 |
| 1101101 | 4061 | 4080 | 48587 | 48606 | TGATGGTTTTAGATCAGAGA | 8 | 826 |
| 1101102 | 4079 | 4098 | 48605 | 48624 | ACCGTAAAAAACATAGATTG | 47 | 827 |
| 1101103 | 4081 | 4100 | 48607 | 48626 | TTACCGTAAAAAACATAGAT | 62 | 828 |
| 1101104 | 4099 | 4118 | 48625 | 48644 | ACTGAAATATTTACATGATT | 67 | 829 |
| 1101105 | 4108 | 4127 | 48634 | 48653 | GTTTATATTACTGAAATATT | 86 | 830 |
| 1101106 | 4111 | 4130 | 48637 | 48656 | ACAGTTTATATTACTGAAAT | 116 | 831 |
| 1101107 | 4112 | 4131 | 48638 | 48657 | AACAGTTTATATTACTGAAA | 91 | 832 |
| 1101108 | 4113 | 4132 | 48639 | 48658 | AAACAGTTTATATTACTGAA | 86 | 833 |
| 1101109 | 4114 | 4133 | 48640 | 48659 | CAAACAGTTTATATTACTGA | 116 | 834 |
| 1101110 | 4115 | 4134 | 48641 | 48660 | TCAAACAGTTTATATTACTG | 70 | 835 |
| 1101111 | 4117 | 4136 | 48643 | 48662 | TTTCAAACAGTTTATATTAC | 86 | 836 |
| 1101112 | 4120 | 4139 | 48646 | 48665 | CCTTTTCAAACAGTTTATAT | 63 | 837 |
| 1101113 | 4121 | 4140 | 48647 | 48666 | GCCTTTTCAAACAGTTTATA | 36 | 838 |
| 1101115 | 4124 | 4143 | 48650 | 48669 | GCAGCCTTTTCAAACAGTTT | 31 | 839 |
| 1101117 | 4126 | 4145 | 48652 | 48671 | CAGCAGCCTTTTCAAACAGT | 27 | 840 |
| 1101118 | 4128 | 4147 | 48654 | 48673 | TGCAGCAGCCTTTTCAAACA | 36 | 841 |
| 1101119 | 4138 | 4157 | 48664 | 48683 | AGAGTTTACCTGCAGCAGCC | 36 | 842 |
| 1101120 | 4140 | 4159 | 48666 | 48685 | ATAGAGTTTACCTGCAGCAG | 21 | 843 |
| 1101121 | 4141 | 4160 | 48667 | 48686 | TATAGAGTTTACCTGCAGCA | 14 | 844 |
| 1101122 | 4142 | 4161 | 48668 | 48687 | GTATAGAGTTTACCTGCAGC | 15 | 845 |
| 1101123 | 4144 | 4163 | 48670 | 48689 | TAGTATAGAGTTTACCTGCA | 32 | 846 |
| 1101124 | 4169 | 4188 | 48695 | 48714 | ATTGTAAATTATTTGGCCAA | 78 | 847 |
| 1101125 | 4170 | 4189 | 48696 | 48715 | AATTGTAAATTATTTGGCCA | 84 | 848 |
| 1101126 | 4171 | 4190 | 48697 | 48716 | GAATTGTAAATTATTTGGCC | 57 | 849 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101127 | 4172 | 4191 | 48698 | 48717 | TGAATTGTAAATTATTTGGC | 44 | 850 |
| 1101128 | 4173 | 4192 | 48699 | 48718 | GTGAATTGTAAATTATTTGG | 26 | 851 |
| 1101129 | 4178 | 4197 | 48704 | 48723 | ATTCTGTGAATTGTAAATTA | 42 | 852 |
| 1101130 | 4191 | 4210 | 48717 | 48736 | CCTTAAATAAAATATTCTGT | 87 | 853 |
| 1101131 | 4197 | 4216 | 48723 | 48742 | GCACCACCTTAAATAAAATA | 62 | 854 |
| 1101132 | 4200 | 4219 | 48726 | 48745 | AAAGCACCACCTTAAATAAA | 83 | 855 |
| 1101133 | 4224 | 4243 | 48750 | 48769 | ATCAAGTTTTAAGGACAAAA | 56 | 856 |
| 1101134 | 4226 | 4245 | 48752 | 48771 | AAATCAAGTTTTAAGGACAA | 88 | 857 |
| 1101135 | 4227 | 4246 | 48753 | 48772 | AAAATCAAGTTTTAAGGACA | 84 | 858 |
| 1101136 | 4228 | 4247 | 48754 | 48773 | AAAAATCAAGTTTTAAGGAC | 94 | 859 |
| 1101137 | 4236 | 4255 | 48762 | 48781 | AAGTTAAGAAAAATCAAGTT | 82 | 860 |
| 1101138 | 4253 | 4272 | 48779 | 48798 | CTTTGGCATCATGAATAAAG | 35 | 861 |
| 1101139 | 4330 | 4349 | 48856 | 48875 | AATATTAAACAATATGGACT | 54 | 862 |
| 1101140 | 4332 | 4351 | 48858 | 48877 | TTAATATTAAACAATATGGA | 88 | 863 |
| 1101141 | 4334 | 4353 | 48860 | 48879 | ACTTAATATTAAACAATATG | 114 | 864 |
| 1101142 | 4335 | 4354 | 48861 | 48880 | AACTTAATATTAAACAATAT | 87 | 865 |
| 1101143 | 4343 | 4362 | 48869 | 48888 | TTTTATTCAACTTAATATTA | 100 | 866 |
| 1101144 | 4352 | 4371 | 48878 | 48897 | TAAAATTTATTTTATTCAAC | 99 | 867 |
| 1101145 | 4380 | 4399 | 48906 | 48925 | CAAAATGTGATTTAGGCTCT | 34 | 868 |
| 1101146 | 4389 | 4408 | 48915 | 48934 | TCAGACAATCAAAATGTGAT | 44 | 869 |
| 1101147 | 4397 | 4416 | 48923 | 48942 | TCAAAAATTCAGACAATCAA | 85 | 870 |
| 1101148 | 4399 | 4418 | 48925 | 48944 | TATCAAAAATTCAGACAATC | 74 | 871 |
| 1101149 | 4400 | 4419 | 48926 | 48945 | GTATCAAAAATTCAGACAAT | 71 | 872 |
| 1101151 | 4403 | 4422 | 48929 | 48948 | ATAGTATCAAAAATTCAGAC | 84 | 873 |
| 1101153 | 4758 | 4777 | 49284 | 49303 | GGTTTTAAGAATTTAGTAGC | 26 | 874 |
| 1101154 | 4759 | 4778 | 49285 | 49304 | CGGTTTTAAGAATTTAGTAG | 57 | 875 |
| 1101155 | 4762 | 4781 | 49288 | 49307 | GGCCGGTTTTAAGAATTTAG | 74 | 876 |
| 1101156 | 4793 | 4812 | 49319 | 49338 | GAATCTATTTTTTATCTGTA | 33 | 877 |
| 1101157 | 4820 | 4839 | 49346 | 49365 | AAAATTATCATATTTTGATT | 76 | 878 |
| 1101158 | 4821 | 4840 | 49347 | 49366 | TAAAATTATCATATTTTGAT | 97 | 879 |
| 1101159 | 4827 | 4846 | 49353 | 49372 | AGATTTTAAAATTATCATAT | 79 | 880 |
| 1101160 | 4831 | 4850 | 49357 | 49376 | CTTAAGATTTTAAAATTATC | 94 | 881 |
| 1101161 | 4834 | 4853 | 49360 | 49379 | CTACTTAAGATTTTAAAATT | 116 | 882 |
| 1101162 | 4841 | 4860 | 49367 | 49386 | TATTTTTCTACTTAAGATTT | 81 | 883 |
| 1101163 | 4843 | 4862 | 49369 | 49388 | TTTATTTTTCTACTTAAGAT | 130 | 884 |
| 1101164 | 4845 | 4864 | 49371 | 49390 | GATTTATTTTTCTACTTAAG | 85 | 885 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101165 | 4850 | 4869 | 49376 | 49395 | ATCAAGATTTATTTTTCTAC | 54 | 886 |
| 1101166 | 4851 | 4870 | 49377 | 49396 | CATCAAGATTTATTTTTCTA | 79 | 887 |
| 1101167 | 4853 | 4872 | 49379 | 49398 | AACATCAAGATTTATTTTTC | 90 | 888 |
| 1101168 | 4859 | 4878 | 49385 | 49404 | ATTTAAAACATCAAGATTTA | 98 | 889 |
| 1101169 | 4864 | 4883 | 49390 | 49409 | TAAGAATTTAAAACATCAAG | 63 | 890 |
| 1101170 | 4865 | 4884 | 49391 | 49410 | GTAAGAATTTAAAACATCAA | 76 | 891 |
| 1101171 | 4887 | 4906 | 49413 | 49432 | CAATATTAACTATTGAATCC | 88 | 892 |
| 1101172 | 5256 | 5275 | 49782 | 49801 | ATAAAGTTTTTAATAGGAAG | 99 | 893 |
| 1101173 | 5258 | 5277 | 49784 | 49803 | GGATAAAGTTTTTAATAGGA | 52 | 894 |
| 1101174 | 5556 | 5575 | 50082 | 50101 | CAAACAAACCTTTAAGATGG | 95 | 895 |
| 1101175 | 5557 | 5576 | 50083 | 50102 | ACAAACAAACCTTTAAGATG | 93 | 896 |
| 1101176 | 5575 | 5594 | 50101 | 50120 | TTTCCGGATTAAAAAAAAAC | 103 | 897 |
| 1101177 | 5801 | 5820 | 50327 | 50346 | AAAAAAAACAAATATTCGCC | 88 | 898 |
| 1101178 | 5802 | 5821 | 50328 | 50347 | TAAAAAAAACAAATATTCGC | 101 | 899 |
| 1101179 | 5947 | 5966 | 50473 | 50492 | AAACAATTCACTTTGAAAAC | 74 | 900 |
| 1101180 | 5950 | 5969 | 50476 | 50495 | AACAAACAATTCACTTTGAA | 62 | 901 |
| 1101181 | 5951 | 5970 | 50477 | 50496 | CAACAAACAATTCACTTTGA | 67 | 902 |
| 1101182 | 5952 | 5971 | 50478 | 50497 | ACAACAAACAATTCACTTTG | 44 | 903 |
| 1101183 | 5953 | 5972 | 50479 | 50498 | TACAACAAACAATTCACTTT | 102 | 904 |
| 1101184 | 5954 | 5973 | 50480 | 50499 | ATACAACAAACAATTCACTT | 63 | 905 |
| 1101185 | 5955 | 5974 | 50481 | 50500 | GATACAACAAACAATTCACT | 56 | 906 |
| 1101187 | 5958 | 5977 | 50484 | 50503 | CTCGATACAACAAACAATTC | 63 | 907 |
| 1101189 | 5960 | 5979 | 50486 | 50505 | GACTCGATACAACAAACAAT | 54 | 908 |
| 1101190 | 5961 | 5980 | 50487 | 50506 | GGACTCGATACAACAAACAA | 63 | 909 |
| 1101191 | 5962 | 5981 | 50488 | 50507 | AGGACTCGATACAACAAACA | 41 | 910 |
| 1101192 | 5963 | 5982 | 50489 | 50508 | AAGGACTCGATACAACAAAC | 38 | 911 |
| 1101193 | 5965 | 5984 | 50491 | 50510 | TTAAGGACTCGATACAACAA | 55 | 912 |
| 1101194 | 5976 | 5995 | 50502 | 50521 | TATATCCATACTTAAGGACT | 70 | 913 |
| 1101195 | 5986 | 6005 | 50512 | 50531 | GGGTCACATATATATCCATA | 71 | 914 |
| 1101196 | 5988 | 6007 | 50514 | 50533 | TAGGGTCACATATATATCCA | 51 | 915 |
| 1101197 | 5992 | 6011 | 50518 | 50537 | TAATTAGGGTCACATATATA | 98 | 916 |
| 1101198 | 5994 | 6013 | 50520 | 50539 | CTTAATTAGGGTCACATATA | 46 | 917 |
| 1101199 | 5995 | 6014 | 50521 | 50540 | TCTTAATTAGGGTCACATAT | 35 | 918 |
| 1101200 | 5996 | 6015 | 50522 | 50541 | TTCTTAATTAGGGTCACATA | 45 | 919 |
| 1101201 | 5997 | 6016 | 50523 | 50542 | GTTCTTAATTAGGGTCACAT | 20 | 920 |
| 1101202 | 5998 | 6017 | 50524 | 50543 | AGTTCTTAATTAGGGTCACA | 18 | 921 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101203 | 5999 | 6018 | 50525 | 50544 | TAGTTCTTAATTAGGGTCAC | 20 | 922 |
| 1101204 | 6000 | 6019 | 50526 | 50545 | GTAGTTCTTAATTAGGGTCA | 21 | 923 |
| 1101205 | 6002 | 6021 | 50528 | 50547 | TGGTAGTTCTTAATTAGGGT | 25 | 924 |
| 1101206 | 6018 | 6037 | 50544 | 50563 | ATTAGTTGATCCAATCTGGT | 52 | 925 |
| 1101207 | 6019 | 6038 | 50545 | 50564 | GATTAGTTGATCCAATCTGG | 40 | 926 |
| 1101208 | 6028 | 6047 | 50554 | 50573 | TGCTGACATGATTAGTTGAT | 41 | 927 |
| 1101209 | 6029 | 6048 | 50555 | 50574 | TTGCTGACATGATTAGTTGA | 51 | 928 |
| 1101210 | 6032 | 6051 | 50558 | 50577 | ACATTGCTGACATGATTAGT | 54 | 929 |
| 1101211 | 6041 | 6060 | 50567 | 50586 | AAGTTATTTACATTGCTGAC | 34 | 930 |
| 1101212 | 6044 | 6063 | 50570 | 50589 | ATAAAGTTATTTACATTGCT | 72 | 931 |
| 1101213 | 6045 | 6064 | 50571 | 50590 | AATAAAGTTATTTACATTGC | 86 | 932 |
| 1101214 | 6056 | 6075 | 50582 | 50601 | TGAATATGAAAAATAAAGTT | 112 | 933 |
| 1101215 | 6067 | 6086 | 50593 | 50612 | AGTTTTTATTTTGAATATGA | 75 | 934 |
| 1101216 | 6071 | 6090 | 50597 | 50616 | AGAAAGTTTTTATTTTGAAT | 99 | 935 |
| 1101217 | 6121 | 6140 | 50647 | 50666 | GTCATTTTTTAAAGCAAAAA | 110 | 936 |
| 1101218 | 6124 | 6143 | 50650 | 50669 | CAGGTCATTTTTTAAAGCAA | 32 | 937 |
| 1101219 | 6135 | 6154 | 50661 | 50680 | AAATACAAAGCCAGGTCATT | 64 | 938 |
| 1101220 | 6141 | 6160 | 50667 | 50686 | CTAAAAAAATACAAAGCCAG | 111 | 939 |
| 1101221 | 6142 | 6161 | 50668 | 50687 | ACTAAAAAAATACAAAGCCA | 55 | 940 |
| 1101223 | 6151 | 6170 | 50677 | 50696 | ATGTTTAAGACTAAAAAAAT | 90 | 941 |
| 1101225 | 6201 | 6220 | 50727 | 50746 | GTCAATAATCTTCACTCATG | 47 | 942 |
| 1101226 | 6205 | 6224 | 50731 | 50750 | CGATGTCAATAATCTTCACT | 71 | 943 |
| 1101227 | 6214 | 6233 | 50740 | 50759 | ATTTACCAACGATGTCAATA | 58 | 944 |
| 1101228 | 6216 | 6235 | 50742 | 50761 | GAATTTACCAACGATGTCAA | 58 | 945 |
| 1101229 | 6219 | 6238 | 50745 | 50764 | CTAGAATTTACCAACGATGT | 49 | 946 |
| 1101230 | 6223 | 6242 | 50749 | 50768 | AATTCTAGAATTTACCAACG | 57 | 947 |
| 1101231 | 6224 | 6243 | 50750 | 50769 | AAATTCTAGAATTTACCAAC | 63 | 948 |
| 1101232 | 6225 | 6244 | 50751 | 50770 | AAAATTCTAGAATTTACCAA | 101 | 949 |
| 1101233 | 6228 | 6247 | 50754 | 50773 | ATCAAAATTCTAGAATTTAC | 85 | 950 |
| 1101234 | 6230 | 6249 | 50756 | 50775 | AAATCAAAATTCTAGAATTT | 95 | 951 |
| 1101235 | 6232 | 6251 | 50758 | 50777 | CAAAATCAAAATTCTAGAAT | 107 | 952 |
| 1101236 | 6301 | 6320 | 50827 | 50846 | ACTAATTCTTAAAATGCCAG | 66 | 953 |
| 1101237 | 6302 | 6321 | 50828 | 50847 | CACTAATTCTTAAAATGCCA | 64 | 954 |
| 1101238 | 6332 | 6351 | 50858 | 50877 | TTACGACAAATTTAGAAGTT | 100 | 955 |
| 1101239 | 6341 | 6360 | 50867 | 50886 | ACATGCCAATTACGACAAAT | 65 | 956 |
| 1101240 | 6351 | 6370 | 50877 | 50896 | ATGCTATTAAACATGCCAAT | 52 | 957 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101241 | 6353 | 6372 | 50879 | 50898 | ATATGCTATTAAACATGCCA | 28 | 958 |
| 1101242 | 6354 | 6373 | 50880 | 50899 | GATATGCTATTAAACATGCC | 75 | 959 |
| 1101243 | 6355 | 6374 | 50881 | 50900 | TGATATGCTATTAAACATGC | 63 | 960 |
| 1101244 | 6363 | 6382 | 50889 | 50908 | ATGTTTTTGATATGCTATT | 60 | 961 |
| 1101245 | 6364 | 6383 | 50890 | 50909 | AATGTTTTTGATATGCTAT | 38 | 962 |
| 1101246 | 6365 | 6384 | 50891 | 50910 | AAATGTTTTTGATATGCTA | 69 | 963 |
| 1101247 | 6366 | 6385 | 50892 | 50911 | AAAATGTTTTTGATATGCT | 75 | 964 |
| 1101248 | 6376 | 6395 | 50902 | 50921 | CCACAGGCTTAAAATGTTTT | 87 | 965 |
| 1101249 | 6384 | 6403 | 50910 | 50929 | CTATGAATCCACAGGCTTAA | 47 | 966 |
| 1101250 | 6406 | 6425 | 50932 | 50951 | CTAATGTTTCTCATTGCTTT | 48 | 967 |
| 1101251 | 6420 | 6439 | 50946 | 50965 | CCATTTATATTTTACTAATG | 91 | 968 |
| 1101252 | 6423 | 6442 | 50949 | 50968 | TATCCATTTATATTTTACTA | 59 | 969 |
| 1101253 | 6427 | 6446 | 50953 | 50972 | GGAATATCCATTTATATTTT | 53 | 970 |
| 1101254 | 6447 | 6466 | 50973 | 50992 | AGAGCTTCCTAAATGCATCA | 62 | 971 |
| 1101255 | 6480 | 6499 | 51006 | 51025 | AAAACATTCCTTGAACTATG | 71 | 972 |
| 1101256 | 6482 | 6501 | 51008 | 51027 | AGAAAACATTCCTTGAACTA | 71 | 973 |
| 1101257 | 6484 | 6503 | 51010 | 51029 | TCAGAAAACATTCCTTGAAC | 77 | 974 |
| 1101259 | 6546 | 6565 | 51072 | 51091 | GATAATCACATTTAAAAATG | 82 | 975 |
| 1101261 | 6552 | 6571 | 51078 | 51097 | AAATTAGATAATCACATTTA | 107 | 976 |
| 1101262 | 6553 | 6572 | 51079 | 51098 | AAAATTAGATAATCACATTT | 95 | 977 |
| 1101263 | 6554 | 6573 | 51080 | 51099 | AAAAATTAGATAATCACATT | 112 | 978 |
| 1101264 | 6555 | 6574 | 51081 | 51100 | TAAAAATTAGATAATCACAT | 81 | 979 |
| 1101265 | 6557 | 6576 | 51083 | 51102 | TGTAAAAATTAGATAATCAC | 103 | 980 |
| 1101266 | 6560 | 6579 | 51086 | 51105 | TGTTGTAAAAATTAGATAAT | 119 | 981 |
| 1101267 | 6561 | 6580 | 51087 | 51106 | GTGTTGTAAAAATTAGATAA | 73 | 982 |
| 1101268 | 6562 | 6581 | 51088 | 51107 | AGTGTTGTAAAAATTAGATA | 88 | 983 |
| 1101269 | 6563 | 6582 | 51089 | 51108 | CAGTGTTGTAAAAATTAGAT | 81 | 984 |
| 1101270 | 6571 | 6590 | 51097 | 51116 | TAATAGCCCAGTGTTGTAAA | 46 | 985 |
| 1101271 | 6573 | 6592 | 51099 | 51118 | CCTAATAGCCCAGTGTTGTA | 39 | 986 |
| 1101272 | 6574 | 6593 | 51100 | 51119 | TCCTAATAGCCCAGTGTTGT | 48 | 987 |
| 1101273 | 6575 | 6594 | 51101 | 51120 | TTCCTAATAGCCCAGTGTTG | 49 | 988 |
| 1101274 | 6580 | 6599 | 51106 | 51125 | AGTTATTCCTAATAGCCCAG | 38 | 989 |
| 1101275 | 6581 | 6600 | 51107 | 51126 | AAGTTATTCCTAATAGCCCA | 56 | 990 |
| 1101276 | 6582 | 6601 | 51108 | 51127 | AAAGTTATTCCTAATAGCCC | 52 | 991 |
| 1101277 | 6583 | 6602 | 51109 | 51128 | AAAAGTTATTCCTAATAGCC | 60 | 992 |
| 1101278 | 6584 | 6603 | 51110 | 51129 | AAAAAGTTATTCCTAATAGC | 81 | 993 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101279 | 6585 | 6604 | 51111 | 51130 | TAAAAAGTTATTCCTAATAG | 78 | 994 |
| 1101280 | 6587 | 6606 | 51113 | 51132 | TTTAAAAAGTTATTCCTAAT | 108 | 995 |
| 1101281 | 6600 | 6619 | 51126 | 51145 | CAGAACAGTAATTTTTAAAA | 106 | 996 |
| 1101282 | 6604 | 6623 | 51130 | 51149 | TATACAGAACAGTAATTTTT | 64 | 997 |
| 1101283 | 6605 | 6624 | 51131 | 51150 | TTATACAGAACAGTAATTTT | 85 | 998 |
| 1101284 | 6606 | 6625 | 51132 | 51151 | TTTATACAGAACAGTAATTT | 95 | 999 |
| 1101285 | 6607 | 6626 | 51133 | 51152 | ATTTATACAGAACAGTAATT | 104 | 1000 |
| 1101286 | 6612 | 6631 | 51138 | 51157 | CAAATATTTATACAGAACAG | 78 | 1001 |
| 1101287 | 6614 | 6633 | 51140 | 51159 | TTCAAATATTTATACAGAAC | 70 | 1002 |
| 1101288 | 6615 | 6634 | 51141 | 51160 | TTTCAAATATTTATACAGAA | 42 | 1003 |
| 1101289 | 6616 | 6635 | 51142 | 51161 | ATTTCAAATATTTATACAGA | 87 | 1004 |
| 1101290 | 6618 | 6637 | 51144 | 51163 | GAATTTCAAATATTTATACA | 97 | 1005 |
| 1101291 | 6621 | 6640 | 51147 | 51166 | CTTGAATTTCAAATATTTAT | 94 | 1006 |
| 1101292 | 6636 | 6655 | 51162 | 51181 | CAGATATTTTCTGTACTTGA | 32 | 1007 |
| 1101293 | 6645 | 6664 | 51171 | 51190 | TTTTTGTTTCAGATATTTTC | 82 | 1008 |
| 1101295 | 6661 | 6680 | 51187 | 51206 | GGCCAAACAACAATGCTTTT | 72 | 1009 |
| 1101297 | 6664 | 6683 | 51190 | 51209 | CATGGCCAAACAACAATGCT | 83 | 1010 |
| 1101298 | 6665 | 6684 | 51191 | 51210 | TCATGGCCAAACAACAATGC | 80 | 1011 |
| 1101299 | 6667 | 6686 | 51193 | 51212 | TATCATGGCCAAACAACAAT | 76 | 1012 |
| 1101300 | 6674 | 6693 | 51200 | 51219 | GCACTTGTATCATGGCCAAA | 50 | 1013 |
| 1101301 | 6675 | 6694 | 51201 | 51220 | TGCACTTGTATCATGGCCAA | 64 | 1014 |
| 1101302 | 6750 | 6769 | 51276 | 51295 | AGCAAATGAACTTAACGAGG | 32 | 1015 |
| 1101303 | 6756 | 6775 | 51282 | 51301 | AATAACAGCAAATGAACTTA | 64 | 1016 |
| 1101304 | 6762 | 6781 | 51288 | 51307 | GTGTGTAATAACAGCAAATG | 52 | 1017 |
| 1101305 | 6764 | 6783 | 51290 | 51309 | GTGTGTGTAATAACAGCAAA | 81 | 1018 |
| 1101306 | 6765 | 6784 | 51291 | 51310 | TGTGTGTGTAATAACAGCAA | 65 | 1019 |
| 1101307 | 6798 | 6817 | 51324 | 51343 | GCCCGGCTTTTCTAACGACC | 77 | 1020 |
| 1101308 | 6839 | 6858 | 51365 | 51384 | CACACTAACAACAGAATCCT | 75 | 1021 |
| 1101309 | 6841 | 6860 | 51367 | 51386 | TCCACACTAACAACAGAATC | 94 | 1022 |
| 1101310 | 6842 | 6861 | 51368 | 51387 | ATCCACACTAACAACAGAAT | 72 | 1023 |
| 1101311 | 6844 | 6863 | 51370 | 51389 | ACATCCACACTAACAACAGA | 57 | 1024 |
| 1101312 | 6845 | 6864 | 51371 | 51390 | AACATCCACACTAACAACAG | 70 | 1025 |
| 1101313 | 6846 | 6865 | 51372 | 51391 | GAACATCCACACTAACAACA | 73 | 1026 |
| 1101314 | 6848 | 6867 | 51374 | 51393 | TTGAACATCCACACTAACAA | 73 | 1027 |
| 1101315 | 6851 | 6870 | 51377 | 51396 | TCATTGAACATCCACACTAA | 62 | 1028 |
| 1101316 | 6852 | 6871 | 51378 | 51397 | CTCATTGAACATCCACACTA | 70 | 1029 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101317 | 6853 | 6872 | 51379 | 51398 | ACTCATTGAACATCCACACT | 69 | 1030 |
| 1101318 | 6854 | 6873 | 51380 | 51399 | AACTCATTGAACATCCACAC | 67 | 1031 |
| 1101319 | 6860 | 6879 | 51386 | 51405 | AAATACAACTCATTGAACAT | 66 | 1032 |
| 1101320 | 6861 | 6880 | 51387 | 51406 | AAAATACAACTCATTGAACA | 88 | 1033 |
| 1101321 | 6862 | 6881 | 51388 | 51407 | TAAAATACAACTCATTGAAC | 81 | 1034 |
| 1101322 | 6863 | 6882 | 51389 | 51408 | TTAAAATACAACTCATTGAA | 102 | 1035 |
| 1101323 | 6865 | 6884 | 51391 | 51410 | ATTTAAAATACAACTCATTG | 73 | 1036 |
| 1101324 | 6867 | 6886 | 51393 | 51412 | ATATTTAAAATACAACTCAT | 101 | 1037 |
| 1101325 | 6868 | 6887 | 51394 | 51413 | GATATTTAAAATACAACTCA | 38 | 1038 |
| 1101326 | 6869 | 6888 | 51395 | 51414 | TGATATTTAAAATACAACTC | 83 | 1039 |
| 1101327 | 6870 | 6889 | 51396 | 51415 | TTGATATTTAAAATACAACT | 77 | 1040 |
| 1101328 | 6871 | 6890 | 51397 | 51416 | TTTGATATTTAAAATACAAC | 77 | 1041 |
| 1101329 | 6880 | 6899 | 51406 | 51425 | TTAATAATCTTTGATATTTA | 129 | 1042 |
| 1101331 | 6887 | 6906 | 51413 | 51432 | TCTTTATTTAATAATCTTTG | 80 | 1043 |
| 1101333 | 6891 | 6910 | 51417 | 51436 | ATTATCTTTATTTAATAATC | 91 | 1044 |
| 1101334 | 6895 | 6914 | 51421 | 51440 | AAACATTATCTTTATTTAAT | 79 | 1045 |
| 1101335 | 6902 | 6921 | 51428 | 51447 | GAAAAGCAAACATTATCTTT | 99 | 1046 |
| 1101336 | 90 | 109 | N/A | N/A | AAAGTGAGCCTTCTTGTTTC | 57 | 1047 |
| 1101337 | 92 | 111 | N/A | N/A | ACAAAGTGAGCCTTCTTGTT | 54 | 1048 |
| 1101338 | 93 | 112 | N/A | N/A | CACAAAGTGAGCCTTCTTGT | 62 | 1049 |
| 1101339 | 94 | 113 | 13163 | 13182 | GCACAAAGTGAGCCTTCTTG | 11 | 1050 |
| 1101340 | 95 | 114 | 13164 | 13183 | AGCACAAAGTGAGCCTTCTT | 35 | 1051 |
| 1101341 | 96 | 115 | 13165 | 13184 | GAGCACAAAGTGAGCCTTCT | 102 | 1052 |
| 1101342 | 97 | 116 | 13166 | 13185 | TGAGCACAAAGTGAGCCTTC | 75 | 1053 |
| 1101343 | 98 | 117 | 13167 | 13186 | TTGAGCACAAAGTGAGCCTT | 60 | 1054 |
| 1101344 | 100 | 119 | 13169 | 13188 | TGTTGAGCACAAAGTGAGCC | 45 | 1055 |
| 1101345 | 116 | 135 | 13185 | 13204 | TAAGTTATTCAGGCAATGTT | 35 | 1056 |
| 1101346 | 118 | 137 | 13187 | 13206 | AATAAGTTATTCAGGCAATG | 34 | 1057 |
| 1101347 | 136 | 155 | 13205 | 13224 | CTAAAATATTCTCCTTGCAA | 51 | 1058 |
| 1101348 | 137 | 156 | 13206 | 13225 | GCTAAAATATTCTCCTTGCA | 33 | 1059 |
| 1101349 | 138 | 157 | 13207 | 13226 | GGCTAAAATATTCTCCTTGC | 12 | 1060 |
| 1101350 | 152 | 171 | 13221 | 13240 | GGATAATTCCACAGGGCTAA | 13 | 1061 |
| 1101351 | 153 | 172 | 13222 | 13241 | AGGATAATTCCACAGGGCTA | 9 | 1062 |
| 1101352 | 154 | 173 | 13223 | 13242 | GAGGATAATTCCACAGGGCT | 12 | 1063 |
| 1101353 | 155 | 174 | 13224 | 13243 | TGAGGATAATTCCACAGGGC | 21 | 1064 |
| 1101354 | 156 | 175 | 13225 | 13244 | TTGAGGATAATTCCACAGGG | 21 | 1065 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101355 | 157 | 176 | 13226 | 13245 | ATTGAGGATAATTCCACAGG | 46 | 1066 |
| 1101356 | 158 | 177 | 13227 | 13246 | AATTGAGGATAATTCCACAG | 53 | 1067 |
| 1101357 | 183 | 202 | 13252 | 13271 | TCTCCTCCTCATCCAGCTGA | 54 | 1068 |
| 1101358 | 184 | 203 | 13253 | 13272 | CTCTCCTCCTCATCCAGCTG | 83 | 1069 |
| 1101359 | 186 | 205 | 13255 | 13274 | TCCTCTCCTCCTCATCCAGC | 28 | 1070 |
| 1101360 | 187 | 206 | 13256 | 13275 | ATCCTCTCCTCCTCATCCAG | 44 | 1071 |
| 1101361 | 189 | 208 | 13258 | 13277 | TCATCCTCTCCTCCTCATCC | 41 | 1072 |
| 1101362 | 193 | 212 | 13262 | 13281 | ATTCTCATCCTCTCCTCCTC | 37 | 1073 |
| 1101363 | 194 | 213 | 13263 | 13282 | CATTCTCATCCTCTCCTCCT | 49 | 1074 |
| 1101364 | 197 | 216 | 13266 | 13285 | TGCCATTCTCATCCTCTCCT | 15 | 1075 |
| 1101365 | 198 | 217 | 13267 | 13286 | CTGCCATTCTCATCCTCTCC | 26 | 1076 |
| 1101367 | 211 | 230 | 13280 | 13299 | GTAACTCCTCCTTCTGCCAT | 31 | 1077 |
| 1101369 | 214 | 233 | 13283 | 13302 | CTAGTAACTCCTCCTTCTGC | 35 | 1078 |
| 1101370 | 215 | 234 | 13284 | 13303 | ACTAGTAACTCCTCCTTCTG | 22 | 1079 |
| 1101371 | 217 | 236 | 13286 | 13305 | TCACTAGTAACTCCTCCTTC | 75 | 1080 |
| 1101372 | 218 | 237 | 13287 | 13306 | TTCACTAGTAACTCCTCCTT | 69 | 1081 |
| 1101373 | 220 | 239 | 13289 | 13308 | TCTTCACTAGTAACTCCTCC | 67 | 1082 |
| 1101374 | 225 | 244 | 13294 | 13313 | GATAATCTTCACTAGTAACT | 66 | 1083 |
| 1101375 | 227 | 246 | 13296 | 13315 | GCGATAATCTTCACTAGTAA | 35 | 1084 |
| 1101376 | 228 | 247 | 13297 | 13316 | TGCGATAATCTTCACTAGTA | 60 | 1085 |
| 1101377 | 229 | 248 | 13298 | 13317 | GTGCGATAATCTTCACTAGT | 97 | 1086 |
| 1101378 | 230 | 249 | 13299 | 13318 | CGTGCGATAATCTTCACTAG | 74 | 1087 |
| 1101379 | 248 | 267 | N/A | N/A | AGAAGGCTGCTGTAAAAACG | 44 | 1088 |
| 1101380 | 249 | 268 | N/A | N/A | CAGAAGGCTGCTGTAAAAAC | 51 | 1089 |
| 1101381 | 251 | 270 | N/A | N/A | TCCAGAAGGCTGCTGTAAAA | 51 | 1090 |
| 1101382 | 258 | 277 | 13863 | 13882 | CCATATTTCCAGAAGGCTGC | 35 | 1091 |
| 1101383 | 259 | 278 | 13864 | 13883 | TCCATATTTCCAGAAGGCTG | 21 | 1092 |
| 1101384 | 260 | 279 | 13865 | 13884 | ATCCATATTTCCAGAAGGCT | 15 | 1093 |
| 1101385 | 261 | 280 | 13866 | 13885 | CATCCATATTTCCAGAAGGC | 26 | 1094 |
| 1101386 | 262 | 281 | 13867 | 13886 | TCATCCATATTTCCAGAAGG | 56 | 1095 |
| 1101387 | 263 | 282 | 13868 | 13887 | GTCATCCATATTTCCAGAAG | 31 | 1096 |
| 1101388 | 266 | 285 | 13871 | 13890 | ACTGTCATCCATATTTCCAG | 23 | 1097 |
| 1101389 | 267 | 286 | 13872 | 13891 | CACTGTCATCCATATTTCCA | 61 | 1098 |
| 1101390 | 270 | 289 | 13875 | 13894 | AACCACTGTCATCCATATTT | 56 | 1099 |
| 1101391 | 275 | 294 | 13880 | 13899 | GAAAAAACCACTGTCATCCA | 40 | 1100 |
| 1101392 | 276 | 295 | 13881 | 13900 | AGAAAAAACCACTGTCATCC | 60 | 1101 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101393 | 278 | 297 | 13883 | 13902 | AGAGAAAAAACCACTGTCAT | 66 | 1102 |
| 1101394 | 279 | 298 | 13884 | 13903 | TAGAGAAAAAACCACTGTCA | 64 | 1103 |
| 1101395 | 281 | 300 | 13886 | 13905 | AATAGAGAAAAAACCACTGT | 83 | 1104 |
| 1101396 | 282 | 301 | 13887 | 13906 | GAATAGAGAAAAAACCACTG | 62 | 1105 |
| 1101397 | 283 | 302 | 13888 | 13907 | TGAATAGAGAAAAAACCACT | 68 | 1106 |
| 1101398 | 284 | 303 | 13889 | 13908 | CTGAATAGAGAAAAAACCAC | 115 | 1107 |
| 1101405 | 291 | 310 | N/A | N/A | TTATAACCTGAATAGAGAAA | 111 | 1108 |
| 1101406 | 293 | 312 | N/A | N/A | GCTTATAACCTGAATAGAGA | 39 | 1109 |
| 1101407 | 294 | 313 | N/A | N/A | TGCTTATAACCTGAATAGAG | 41 | 1110 |
| 1101408 | 295 | 314 | N/A | N/A | TTGCTTATAACCTGAATAGA | 57 | 1111 |
| 1101409 | 296 | 315 | N/A | N/A | ATTGCTTATAACCTGAATAG | 63 | 1112 |
| 1101410 | 298 | 317 | N/A | N/A | GCATTGCTTATAACCTGAAT | 43 | 1113 |
| 1101411 | 299 | 318 | N/A | N/A | GGCATTGCTTATAACCTGAA | 11 | 1114 |
| 1101412 | N/A | N/A | 51448 | 51467 | CACAAATTCAAAAGGAAATA | 109 | 1115 |
| 1101413 | N/A | N/A | 51449 | 51468 | ACACAAATTCAAAAGGAAAT | 83 | 1116 |
| 1101414 | N/A | N/A | 51451 | 51470 | AAACACAAATTCAAAAGGAA | 92 | 1117 |
| 1101415 | N/A | N/A | 51452 | 51471 | TAAACACAAATTCAAAAGGA | 91 | 1118 |
| 1101416 | N/A | N/A | 51459 | 51478 | TTAACAATAAACACAAATTC | 79 | 1119 |
| 1101417 | N/A | N/A | 51464 | 51483 | ATGAATTAACAATAAACACA | 155 | 1120 |
| 1101418 | N/A | N/A | 51465 | 51484 | TATGAATTAACAATAAACAC | 101 | 1121 |
| 1101419 | N/A | N/A | 51466 | 51485 | CTATGAATTAACAATAAACA | 107 | 1122 |
| 1101420 | N/A | N/A | 51469 | 51488 | TAGCTATGAATTAACAATAA | 99 | 1123 |
| 1101421 | N/A | N/A | 51471 | 51490 | AATAGCTATGAATTAACAAT | 70 | 1124 |
| 1101422 | N/A | N/A | 51857 | 51876 | AATAGAATATCAATGGACTG | 65 | 1125 |
| 1101423 | N/A | N/A | 51860 | 51879 | TGGAATAGAATATCAATGGA | 54 | 1126 |
| 1101424 | N/A | N/A | 51862 | 51881 | GCTGGAATAGAATATCAATG | 52 | 1127 |
| 1101425 | N/A | N/A | 51943 | 51962 | TCAAATAAAAATTTGGAATT | 108 | 1128 |
| 1101426 | N/A | N/A | 51944 | 51963 | TTCAAATAAAAATTTGGAAT | 82 | 1129 |
| 1101427 | N/A | N/A | 52274 | 52293 | TCCTCAATCAGTCTAGGTGG | 89 | 1130 |
| 1101428 | N/A | N/A | 52275 | 52294 | TTCCTCAATCAGTCTAGGTG | 92 | 1131 |
| 1101429 | N/A | N/A | 52281 | 52300 | AATATATTCCTCAATCAGTC | 114 | 1132 |
| 1101430 | N/A | N/A | 52282 | 52301 | CAATATATTCCTCAATCAGT | 90 | 1133 |
| 1101431 | N/A | N/A | 52283 | 52302 | ACAATATATTCCTCAATCAG | 112 | 1134 |
| 1101432 | N/A | N/A | 52338 | 52357 | GTGCCCAATCCTAATTAAAG | 130 | 1135 |
| 1101433 | N/A | N/A | 52339 | 52358 | TGTGCCCAATCCTAATTAAA | 97 | 1136 |
| 1101434 | N/A | N/A | 52352 | 52371 | ATGTTTCAAAATTTGTGCCC | 64 | 1137 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101435 | N/A | N/A | 52354 | 52373 | TTATGTTTCAAAATTTGTGC | 89 | 1138 |
| 1101436 | N/A | N/A | 52355 | 52374 | ATTATGTTTCAAAATTTGTG | 81 | 1139 |
| 1101437 | N/A | N/A | 53333 | 53352 | ACCCTAATACAAGAGACTCT | 110 | 1140 |
| 1101439 | N/A | N/A | 53336 | 53355 | TCTACCCTAATACAAGAGAC | 100 | 1141 |
| 1101441 | N/A | N/A | 53779 | 53798 | CCATGTAGTGACATGTGGCT | 87 | 1142 |
| 1101442 | N/A | N/A | 53929 | 53948 | TTTTGGAAAAAATGGATCTG | 93 | 1143 |
| 1101443 | N/A | N/A | 53930 | 53949 | CTTTTGGAAAAAATGGATCT | 88 | 1144 |
| 1101444 | N/A | N/A | 53931 | 53950 | GCTTTTGGAAAAAATGGATC | 82 | 1145 |
| 1101445 | N/A | N/A | 53944 | 53963 | GAATTCAAACACAGCTTTTG | 90 | 1146 |
| 1101446 | N/A | N/A | 53948 | 53967 | TGCAGAATTCAAACACAGCT | 82 | 1147 |
| 1101447 | N/A | N/A | 53951 | 53970 | CTGTGCAGAATTCAAACACA | 66 | 1148 |
| 1101574 | N/A | N/A | 3683 | 3702 | GCCCATACTCCCTCCCGGCT | 106 | 1149 |
| 1101575 | N/A | N/A | 3690 | 3709 | CGGCCCCGCCCATACTCCCT | 101 | 1150 |
| 1101576 | N/A | N/A | 3740 | 3759 | AGAAGCAAACCCACTGGGCG | 96 | 1151 |
| 1101577 | N/A | N/A | 3885 | 3904 | GAAAAGTTAATTCTGCCAGG | 49 | 1152 |
| 1101578 | N/A | N/A | 3948 | 3967 | ACAAGACCCCAAAGATCTAC | 71 | 1153 |
| 1101579 | N/A | N/A | 4012 | 4031 | AGTGGGCGAGCCAAGGTCTC | 87 | 1154 |
| 1101580 | N/A | N/A | 4093 | 4112 | GTAATAAAAACTCTTGTGAC | 61 | 1155 |
| 1101581 | N/A | N/A | 4109 | 4128 | CAAACCCAAACATCCCGTAA | 135 | 1156 |
| 1101583 | N/A | N/A | 4113 | 4132 | AAACCAAACCCAAACATCCC | 80 | 1157 |
| 1101585 | N/A | N/A | 4128 | 4147 | TGGGAGTACCAAAAGAAACC | 71 | 1158 |
| 1101586 | N/A | N/A | 4165 | 4184 | TACCTAAAAACAAAGCTGGC | 86 | 1159 |
| 1101587 | N/A | N/A | 4166 | 4185 | ATACCTAAAAACAAAGCTGG | 69 | 1160 |
| 1101588 | N/A | N/A | 4168 | 4187 | TAATACCTAAAAACAAAGCT | 90 | 1161 |
| 1101589 | N/A | N/A | 4170 | 4189 | CCTAATACCTAAAAACAAAG | 102 | 1162 |
| 1101590 | N/A | N/A | 4171 | 4190 | TCCTAATACCTAAAAACAAA | 95 | 1163 |
| 1101591 | N/A | N/A | 4172 | 4191 | CTCCTAATACCTAAAAACAA | 81 | 1164 |
| 1101592 | N/A | N/A | 4173 | 4192 | ACTCCTAATACCTAAAAACA | 85 | 1165 |
| 1101593 | N/A | N/A | 4174 | 4193 | CACTCCTAATACCTAAAAAC | 83 | 1166 |
| 1101594 | N/A | N/A | 4175 | 4194 | CCACTCCTAATACCTAAAAA | 117 | 1167 |
| 1101595 | N/A | N/A | 4180 | 4199 | CCAGTCCACTCCTAATACCT | 63 | 1168 |
| 1101596 | N/A | N/A | 4194 | 4213 | ACAACAAAATCATCCCAGTC | 77 | 1169 |
| 1101597 | N/A | N/A | 4195 | 4214 | TACAACAAAATCATCCCAGT | 71 | 1170 |
| 1101598 | N/A | N/A | 4254 | 4273 | AACAGTATCTTCAAGTGCAT | 53 | 1171 |
| 1101599 | N/A | N/A | 4255 | 4274 | AAACAGTATCTTCAAGTGCA | 52 | 1172 |
| 1101600 | N/A | N/A | 4277 | 4296 | GAGGAGTTTCTTTACATATC | 13 | 1173 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101601 | N/A | N/A | 4357 | 4376 | AACATGATACCATGTGCCAA | 27 | 1174 |
| 1101602 | N/A | N/A | 4375 | 4394 | AACACGAAACTATTATGAAA | 88 | 1175 |
| 1101603 | N/A | N/A | 4415 | 4434 | TCCTCCTATTAAATAACAGC | 62 | 1176 |
| 1101604 | N/A | N/A | 4421 | 4440 | CTTTGCTCCTCCTATTAAAT | 55 | 1177 |
| 1101605 | N/A | N/A | 4459 | 4478 | TAAATGATCATTTATAAGTA | 100 | 1178 |
| 1101606 | N/A | N/A | 4481 | 4500 | TGTGAATTTTAAATGTCTGG | 30 | 1179 |
| 1101607 | N/A | N/A | 4482 | 4501 | GTGTGAATTTTAAATGTCTG | 19 | 1180 |
| 1101608 | N/A | N/A | 4483 | 4502 | TGTGTGAATTTTAAATGTCT | 45 | 1181 |
| 1101609 | N/A | N/A | 4484 | 4503 | GTGTGTGAATTTTAAATGTC | 35 | 1182 |
| 1101610 | N/A | N/A | 4728 | 4747 | TCTCCCAAAAACATTACCTG | 179 | 1183 |
| 1101611 | N/A | N/A | 4732 | 4751 | CGTCTCTCCCAAAAACATTA | 88 | 1184 |
| 1101612 | N/A | N/A | 4857 | 4876 | GTACTTAACAATTTGTTCCA | 46 | 1185 |
| 1101613 | N/A | N/A | 4858 | 4877 | TGTACTTAACAATTTGTTCC | 47 | 1186 |
| 1101614 | N/A | N/A | 4864 | 4883 | AAGCATTGTACTTAACAATT | 55 | 1187 |
| 1101615 | N/A | N/A | 4884 | 4903 | GAGATGTTTTCTACAATGAA | 26 | 1188 |
| 1101616 | N/A | N/A | 4903 | 4922 | GCCTATTTCAAAAGTTTCCG | 42 | 1189 |
| 1101617 | N/A | N/A | 4904 | 4923 | AGCCTATTTCAAAAGTTTCC | 59 | 1190 |
| 1101619 | N/A | N/A | 4949 | 4968 | TAGTGACAACTATACGACTG | 53 | 1191 |
| 1101621 | N/A | N/A | 5009 | 5028 | CCAAGCAACCAAATCTCTAT | 67 | 1192 |
| 1101622 | N/A | N/A | 5351 | 5370 | ATAACAAAAATATGGCCGGG | 91 | 1193 |
| 1101623 | N/A | N/A | 5352 | 5371 | AATAACAAAAATATGGCCGG | 91 | 1194 |
| 1101624 | N/A | N/A | 5353 | 5372 | TAATAACAAAAATATGGCCG | 101 | 1195 |
| 1101625 | N/A | N/A | 5354 | 5373 | TTAATAACAAAAATATGGCC | 85 | 1196 |
| 1101626 | N/A | N/A | 5355 | 5374 | ATTAATAACAAAAATATGGC | 163 | 1197 |
| 1101627 | N/A | N/A | 5356 | 5375 | AATTAATAACAAAAATATGG | 83 | 1198 |
| 1101628 | N/A | N/A | 5363 | 5382 | CTTTGAAAATTAATAACAAA | 115 | 1199 |
| 1101629 | N/A | N/A | 5365 | 5384 | GCCTTTGAAAATTAATAACA | 85 | 1200 |
| 1101630 | N/A | N/A | 5378 | 5397 | GTCCCACACCAAAGCCTTTG | 73 | 1201 |
| 1101631 | N/A | N/A | 5452 | 5471 | ATATTGTTAAAAATCTTGTC | 72 | 1202 |
| 1101632 | N/A | N/A | 5454 | 5473 | CAATATTGTTAAAAATCTTG | 79 | 1203 |
| 1101633 | N/A | N/A | 5959 | 5978 | AAAAACTAAATTGTTGAATC | 98 | 1204 |
| 1101634 | N/A | N/A | 5962 | 5981 | CCAAAAAACTAAATTGTTGA | 77 | 1205 |
| 1101635 | N/A | N/A | 5964 | 5983 | GCCCAAAAAACTAAATTGTT | 98 | 1206 |
| 1101636 | N/A | N/A | 5965 | 5984 | CGCCCAAAAAACTAAATTGT | 87 | 1207 |
| 1101637 | N/A | N/A | 6050 | 6069 | CACAGTAAGCCCAAACATTC | 85 | 1208 |
| 1101638 | N/A | N/A | 6102 | 6121 | AGCAAGGGTTAAAGGTATAT | 68 | 1209 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101639 | N/A | N/A | 6121 | 6140 | CTCTCCAAACCCAGGACCTA | 115 | 1210 |
| 1101640 | N/A | N/A | 6147 | 6166 | CTTTAGGGCCAAAGTTGGTT | 70 | 1211 |
| 1101641 | N/A | N/A | 6156 | 6175 | ACACAGCTTCTTTAGGGCCA | 56 | 1212 |
| 1101642 | N/A | N/A | 6212 | 6231 | CCAAGGTTCCAAGAGGAAAT | 60 | 1213 |
| 1101643 | N/A | N/A | 6221 | 6240 | AAGAGGAAACCAAGGTTCCA | 94 | 1214 |
| 1101644 | N/A | N/A | 6247 | 6266 | AAGGGTACTCAAAGTGACTA | 69 | 1215 |
| 1101645 | N/A | N/A | 6264 | 6283 | TACATTCTAACTTAATAAAG | 93 | 1216 |
| 1101646 | N/A | N/A | 6269 | 6288 | GTTTTTACATTCTAACTTAA | 65 | 1217 |
| 1101647 | N/A | N/A | 6274 | 6293 | AAACTGTTTTTACATTCTAA | 64 | 1218 |
| 1101648 | N/A | N/A | 6275 | 6294 | GAAACTGTTTTTACATTCTA | 58 | 1219 |
| 1101649 | N/A | N/A | 6348 | 6367 | GCCCCATTCAAATATTTATT | 137 | 1220 |
| 1101650 | N/A | N/A | 6558 | 6577 | TCCATTCAAATATATACATT | 74 | 1221 |
| 1101651 | N/A | N/A | 6561 | 6580 | TTATCCATTCAAATATATAC | 90 | 1222 |
| 1101652 | N/A | N/A | 6565 | 6584 | CTCTTTATCCATTCAAATAT | 70 | 1223 |
| 1101653 | N/A | N/A | 6566 | 6585 | TCTCTTTATCCATTCAAATA | 79 | 1224 |
| 1101655 | N/A | N/A | 6593 | 6612 | CATATATATCTCAGAAACTC | 62 | 1225 |
| 1101657 | N/A | N/A | 6597 | 6616 | GCACCATATATATCTCAGAA | 15 | 1226 |
| 1101658 | N/A | N/A | 6598 | 6617 | AGCACCATATATATCTCAGA | 25 | 1227 |
| 1101659 | N/A | N/A | 6599 | 6618 | CAGCACCATATATATCTCAG | 21 | 1228 |
| 1101660 | N/A | N/A | 6601 | 6620 | AACAGCACCATATATATCTC | 54 | 1229 |
| 1101661 | N/A | N/A | 6610 | 6629 | CTTTAGATAAACAGCACCAT | 66 | 1230 |
| 1101662 | N/A | N/A | 6614 | 6633 | TTTACTTTAGATAAACAGCA | 56 | 1231 |
| 1101663 | N/A | N/A | 6639 | 6658 | CCTTAAAATATTTACAGAAA | 78 | 1232 |
| 1101664 | N/A | N/A | 6648 | 6667 | CCTGCAAAGCCTTAAAATAT | 92 | 1233 |
| 1101665 | N/A | N/A | 6667 | 6686 | TGACAGAGACTACAGCTGGC | 85 | 1234 |
| 1101666 | N/A | N/A | 6698 | 6717 | GTTGGGAAAAACATGCACAA | 43 | 1235 |
| 1101667 | N/A | N/A | 6700 | 6719 | TGGTTGGGAAAAACATGCAC | 34 | 1236 |
| 1101668 | N/A | N/A | 6716 | 6735 | ACTTTACATTTTTACATGGT | 25 | 1237 |
| 1101669 | N/A | N/A | 6731 | 6750 | AGTAGCTAAGAATGCACTTT | 74 | 1238 |
| 1101670 | N/A | N/A | 6754 | 6773 | ATGGGCCAAATTCAACCTGC | 90 | 1239 |
| 1101671 | N/A | N/A | 6824 | 6843 | CAACAAAAATCCAGTAGTGG | 68 | 1240 |
| 1101672 | N/A | N/A | 6825 | 6844 | ACAACAAAAATCCAGTAGTG | 68 | 1241 |
| 1101673 | N/A | N/A | 6842 | 6861 | CAGAACTAAAACAAACAACA | 78 | 1242 |
| 1101674 | N/A | N/A | 6844 | 6863 | ACCAGAACTAAAACAAACAA | 92 | 1243 |
| 1101675 | N/A | N/A | 6845 | 6864 | CACCAGAACTAAAACAAACA | 106 | 1244 |
| 1101676 | N/A | N/A | 6847 | 6866 | GGCACCAGAACTAAAACAAA | 67 | 1245 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101677 | N/A | N/A | 6851 | 6870 | AGCAGGCACCAGAACTAAAA | 74 | 1246 |
| 1101678 | N/A | N/A | 6903 | 6922 | TAACTGCACCAAGAAACATC | 93 | 1247 |
| 1101679 | N/A | N/A | 6924 | 6943 | GCACCAATACAAATGGCACA | 60 | 1248 |
| 1101680 | N/A | N/A | 6926 | 6945 | AAGCACCAATACAAATGGCA | 69 | 1249 |
| 1101681 | N/A | N/A | 6941 | 6960 | TTTGCATTACATTAAAAGCA | 64 | 1250 |
| 1101682 | N/A | N/A | 6955 | 6974 | GATATTATTACCAGTTTGCA | 17 | 1251 |
| 1101683 | N/A | N/A | 6977 | 6996 | ATGTACAACCCCAGCAAGTT | 41 | 1252 |
| 1101684 | N/A | N/A | 6978 | 6997 | TATGTACAACCCCAGCAAGT | 73 | 1253 |
| 1101685 | N/A | N/A | 6989 | 7008 | TTCAATAATTTTATGTACAA | 95 | 1254 |
| 1101686 | N/A | N/A | 7037 | 7056 | GGGCATAATGAATGCCACAG | 75 | 1255 |
| 1101687 | N/A | N/A | 7062 | 7081 | TGGCTAAAATCCAGCAATCA | 68 | 1256 |
| 1101688 | N/A | N/A | 7093 | 7112 | GGCTTCTCCTAAAGCTCAAA | 73 | 1257 |
| 1101689 | N/A | N/A | 7110 | 7129 | TCATTTATACAGAATTTGGC | 21 | 1258 |
| 1101691 | N/A | N/A | 7120 | 7139 | GCACTTCAAGTCATTTATAC | 57 | 1259 |
| 1101693 | N/A | N/A | 7304 | 7323 | ACTATCTGCCAGGGAGCCTT | 76 | 1260 |
| 1101694 | N/A | N/A | 7328 | 7347 | GGCAATGGCCAGTACTTCTA | 79 | 1261 |
| 1101695 | N/A | N/A | 7377 | 7396 | TCTCCGAGCCCTTACTATGA | 74 | 1262 |
| 1101696 | N/A | N/A | 7462 | 7481 | AGGTATAAACCTAAGGTGCT | 58 | 1263 |
| 1101697 | N/A | N/A | 7474 | 7493 | ACAACACAAATCAGGTATAA | 93 | 1264 |
| 1101698 | N/A | N/A | 7477 | 7496 | ACTACAACACAAATCAGGTA | 80 | 1265 |
| 1101699 | N/A | N/A | 7479 | 7498 | TAACTACAACACAAATCAGG | 73 | 1266 |
| 1101700 | N/A | N/A | 7485 | 7504 | CACTACTAACTACAACACAA | 70 | 1267 |
| 1101701 | N/A | N/A | 7486 | 7505 | ACACTACTAACTACAACACA | 91 | 1268 |
| 1101702 | N/A | N/A | 7491 | 7510 | CAGAGACACTACTAACTACA | 66 | 1269 |
| 1101703 | N/A | N/A | 7502 | 7521 | GTTCAAATTACCAGAGACAC | 75 | 1270 |
| 1101704 | N/A | N/A | 7504 | 7523 | TAGTTCAAATTACCAGAGAC | 60 | 1271 |
| 1101705 | N/A | N/A | 7505 | 7524 | CTAGTTCAAATTACCAGAGA | 66 | 1272 |
| 1101706 | N/A | N/A | 7508 | 7527 | AAACTAGTTCAAATTACCAG | 84 | 1273 |
| 1101707 | N/A | N/A | 7521 | 7540 | CAAGACCAACCTGAAACTAG | 70 | 1274 |
| 1101708 | N/A | N/A | 7526 | 7545 | GTTTTCAAGACCAACCTGAA | 108 | 1275 |
| 1101709 | N/A | N/A | 7549 | 7568 | TCATTTACCCCCAACCTCCC | 78 | 1276 |
| 1101710 | N/A | N/A | 7552 | 7571 | AAATCATTTACCCCCAACCT | 81 | 1277 |
| 1101711 | N/A | N/A | 7556 | 7575 | TACCAAATCATTTACCCCCA | 53 | 1278 |
| 1101712 | N/A | N/A | 7558 | 7577 | GCTACCAAATCATTTACCCC | 82 | 1279 |
| 1101713 | N/A | N/A | 7559 | 7578 | TGCTACCAAATCATTTACCC | 80 | 1280 |
| 1101714 | N/A | N/A | 7562 | 7581 | AACTGCTACCAAATCATTTA | 53 | 1281 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101715 | N/A | N/A | 7600 | 7619 | GCAGTTCTACAAAGATAATG | 46 | 1282 |
| 1101716 | N/A | N/A | 8424 | 8443 | ATTGAAATCTCATGATTTGG | 92 | 1283 |
| 1101717 | N/A | N/A | 8425 | 8444 | TATTGAAATCTCATGATTTG | 86 | 1284 |
| 1101718 | N/A | N/A | 8447 | 8466 | TGCCATAATCAAAGTTCAGC | 29 | 1285 |
| 1101719 | N/A | N/A | 8449 | 8468 | TTTGCCATAATCAAAGTTCA | 69 | 1286 |
| 1101720 | N/A | N/A | 8453 | 8472 | TCACTTTGCCATAATCAAAG | 52 | 1287 |
| 1101721 | N/A | N/A | 8455 | 8474 | GTTCACTTTGCCATAATCAA | 26 | 1288 |
| 1101722 | N/A | N/A | 8474 | 8493 | AGCTTTAATCAAAGCAGAAG | 86 | 1289 |
| 1101723 | N/A | N/A | 8477 | 8496 | TCAAGCTTTAATCAAAGCAG | 106 | 1290 |
| 1101724 | N/A | N/A | 8504 | 8523 | TCAAACTATCCCCAGCCACC | 107 | 1291 |
| 1101725 | N/A | N/A | 8508 | 8527 | TATCTCAAACTATCCCCAGC | 108 | 1292 |
| 1101727 | N/A | N/A | 8510 | 8529 | CTTATCTCAAACTATCCCCA | 123 | 1293 |
| 1101729 | N/A | N/A | 8514 | 8533 | TGCCCTTATCTCAAACTATC | 104 | 1294 |
| 1101730 | N/A | N/A | 8520 | 8539 | CTGCCTTGCCCTTATCTCAA | 79 | 1295 |
| 1101731 | N/A | N/A | 8531 | 8550 | TATGCATTTTCCTGCCTTGC | 71 | 1296 |
| 1101732 | N/A | N/A | 8571 | 8590 | ACCAAAAGAATTGTACAATG | 85 | 1297 |
| 1101733 | N/A | N/A | 8573 | 8592 | GGACCAAAAGAATTGTACAA | 106 | 1298 |
| 1101734 | N/A | N/A | 8578 | 8597 | CACATGGACCAAAAGAATTG | 114 | 1299 |
| 1101735 | N/A | N/A | 8591 | 8610 | ACGGATCAAATTCCACATGG | 51 | 1300 |
| 1101736 | N/A | N/A | 8785 | 8804 | TGGTTCATACTATAATCTCA | 26 | 1301 |
| 1101737 | N/A | N/A | 8823 | 8842 | TCAGTACAAATTTAAAAATC | 81 | 1302 |
| 1101738 | N/A | N/A | 8826 | 8845 | TGTTCAGTACAAATTTAAAA | 76 | 1303 |
| 1101739 | N/A | N/A | 8831 | 8850 | CAAACTGTTCAGTACAAATT | 71 | 1304 |
| 1101740 | N/A | N/A | 8837 | 8856 | AAAGGACAAACTGTTCAGTA | 35 | 1305 |
| 1101741 | N/A | N/A | 8860 | 8879 | TTCTAATATGATTTAATGGA | 94 | 1306 |
| 1101742 | N/A | N/A | 8861 | 8880 | CTTCTAATATGATTTAATGG | 62 | 1307 |
| 1101743 | N/A | N/A | 8882 | 8901 | CAGGAAATATCAAGTTCTGT | 47 | 1308 |
| 1101744 | N/A | N/A | 8883 | 8902 | ACAGGAAATATCAAGTTCTG | 81 | 1309 |
| 1101745 | N/A | N/A | 8903 | 8922 | CAAAGAAAAACTGTATTGCT | 53 | 1310 |
| 1101746 | N/A | N/A | 8917 | 8936 | AAATCAAACTTCATCAAAGA | 90 | 1311 |
| 1101747 | N/A | N/A | 8918 | 8937 | GAAATCAAACTTCATCAAAG | 52 | 1312 |
| 1101748 | N/A | N/A | 8919 | 8938 | TGAAATCAAACTTCATCAAA | 86 | 1313 |
| 1101749 | N/A | N/A | 8922 | 8941 | ACTTGAAATCAAACTTCATC | 57 | 1314 |
| 1101750 | N/A | N/A | 8947 | 8966 | TAGCTTTAAATTATGAAAAA | 97 | 1315 |
| 1101751 | N/A | N/A | 8948 | 8967 | ATAGCTTTAAATTATGAAAA | 64 | 1316 |
| 1101752 | N/A | N/A | 8950 | 8969 | AAATAGCTTTAAATTATGAA | 99 | 1317 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101753 | N/A | N/A | 8959 | 8978 | CTCTATAAAAAATAGCTTTA | 103 | 1318 |
| 1101754 | N/A | N/A | 8973 | 8992 | TTGATTAAAATTCTCTCTAT | 97 | 1319 |
| 1101755 | N/A | N/A | 8986 | 9005 | GACATCCAAATATTTGATTA | 33 | 1320 |
| 1101756 | N/A | N/A | 8989 | 9008 | AGTGACATCCAAATATTTGA | 49 | 1321 |
| 1101757 | N/A | N/A | 9010 | 9029 | CTTAATACCATATATAGCAA | 71 | 1322 |
| 1101758 | N/A | N/A | 9012 | 9031 | TACTTAATACCATATATAGC | 73 | 1323 |
| 1101759 | N/A | N/A | 9013 | 9032 | ATACTTAATACCATATATAG | 115 | 1324 |
| 1101760 | N/A | N/A | 9023 | 9042 | TATGGTCACCATACTTAATA | 66 | 1325 |
| 1101761 | N/A | N/A | 9033 | 9052 | GTTTACAAACTATGGTCACC | 78 | 1326 |
| 1101763 | N/A | N/A | 9035 | 9054 | GAGTTTACAAACTATGGTCA | 58 | 1327 |
| 1101765 | N/A | N/A | 9064 | 9083 | CACAAATTTCCTGTCTTGCT | 59 | 1328 |
| 1101766 | N/A | N/A | 9068 | 9087 | CTAACACAAATTTCCTGTCT | 62 | 1329 |
| 1101767 | N/A | N/A | 9071 | 9090 | TTGCTAACACAAATTTCCTG | 73 | 1330 |
| 1101768 | N/A | N/A | 9073 | 9092 | CTTTGCTAACACAAATTTCC | 77 | 1331 |
| 1101769 | N/A | N/A | 9083 | 9102 | AGAAAAAAGCCTTTGCTAAC | 95 | 1332 |
| 1101770 | N/A | N/A | 9101 | 9120 | TAAAAAATTCAAACAGTAAG | 86 | 1333 |
| 1101771 | N/A | N/A | 9319 | 9338 | TCAGGCAAAACTCATTTATG | 44 | 1334 |
| 1101772 | N/A | N/A | 9340 | 9359 | TCCAGTCACAAAAGCTCAAA | 65 | 1335 |
| 1101773 | N/A | N/A | 9341 | 9360 | TTCCAGTCACAAAAGCTCAA | 92 | 1336 |
| 1101774 | N/A | N/A | 9389 | 9408 | ATGGTAAACTAAAGAGGACA | 88 | 1337 |
| 1101775 | N/A | N/A | 9392 | 9411 | ACAATGGTAAACTAAAGAGG | 63 | 1338 |
| 1101776 | N/A | N/A | 9400 | 9419 | TTTCTCAAACAATGGTAAAC | 50 | 1339 |
| 1101777 | N/A | N/A | 9406 | 9425 | GATAAATTTCTCAAACAATG | 102 | 1340 |
| 1101778 | N/A | N/A | 9447 | 9466 | AATTAACAATAATTAACAGT | 79 | 1341 |
| 1101779 | N/A | N/A | 9450 | 9469 | GTTAATTAACAATAATTAAC | 103 | 1342 |
| 1101780 | N/A | N/A | 9470 | 9489 | ATGAATTAACTACAACAGTA | 118 | 1343 |
| 1101781 | N/A | N/A | 9500 | 9519 | CTCACAAAAGAATACTAGAT | 61 | 1344 |
| 1101782 | N/A | N/A | 9507 | 9526 | GTGTTTACTCACAAAAGAAT | 65 | 1345 |
| 1101783 | N/A | N/A | 9552 | 9571 | GAAACGACCCAAATGGATAG | 75 | 1346 |
| 1101784 | N/A | N/A | 9554 | 9573 | TGGAAACGACCCAAATGGAT | 80 | 1347 |
| 1101785 | N/A | N/A | 9585 | 9604 | ATAGCATTACTATTTGTAAT | 68 | 1348 |
| 1101786 | N/A | N/A | 9597 | 9616 | ATAGCATTACAGATAGCATT | 40 | 1349 |
| 1101787 | N/A | N/A | 9610 | 9629 | GTAGTAATACAAAATAGCAT | 85 | 1350 |
| 1101788 | N/A | N/A | 9625 | 9644 | ATAGCATTACTATTTGTAGT | 68 | 1351 |
| 1101789 | N/A | N/A | 9746 | 9765 | ATCTCCTATGATCTAGCAAT | 68 | 1352 |
| 1101790 | N/A | N/A | 9761 | 9780 | AAGCTTAATATATACATCTC | 81 | 1353 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101791 | N/A | N/A | 9763 | 9782 | TAAAGCTTAATATATACATC | 115 | 1354 |
| 1101792 | N/A | N/A | 9788 | 9807 | ACTAATAATTATGTAATGCA | 98 | 1355 |
| 1101793 | N/A | N/A | 9790 | 9809 | TAACTAATAATTATGTAATG | 126 | 1356 |
| 1101794 | N/A | N/A | 9791 | 9810 | ATAACTAATAATTATGTAAT | 84 | 1357 |
| 1101795 | N/A | N/A | 9792 | 9811 | AATAACTAATAATTATGTAA | 109 | 1358 |
| 1101796 | N/A | N/A | 9797 | 9816 | CCAATAATAACTAATAATTA | 88 | 1359 |
| 1101797 | N/A | N/A | 9798 | 9817 | ACCAATAATAACTAATAATT | 111 | 1360 |
| 1101799 | N/A | N/A | 9806 | 9825 | TTGGTATAACCAATAATAAC | 85 | 1361 |
| 1101801 | N/A | N/A | 9882 | 9901 | CACAAACTCTAAAATGGCTA | 72 | 1362 |
| 1101802 | N/A | N/A | 9997 | 10016 | GGCAAGACAAACAAGCACTT | 77 | 1363 |
| 1101803 | N/A | N/A | 10199 | 10218 | CTTGAGCCCCAAAAAGGTCG | 93 | 1364 |
| 1101804 | N/A | N/A | 10409 | 10428 | TGAAAAATAGCCAAGGCTGG | 96 | 1365 |
| 1101805 | N/A | N/A | 10424 | 10443 | CTACTTATATCCTTTTGAAA | 65 | 1366 |
| 1101806 | N/A | N/A | 10439 | 10458 | GGATATACAGATGTTCTACT | 25 | 1367 |
| 1101807 | N/A | N/A | 10441 | 10460 | AGGGATATACAGATGTTCTA | 39 | 1368 |
| 1101808 | N/A | N/A | 10443 | 10462 | GAAGGGATATACAGATGTTC | 27 | 1369 |
| 1101809 | N/A | N/A | 10463 | 10482 | TACTGAATAATATGCAAATT | 99 | 1370 |
| 1101810 | N/A | N/A | 10468 | 10487 | ACTCTTACTGAATAATATGC | 75 | 1371 |
| 1101811 | N/A | N/A | 10489 | 10508 | TATTTCTACTACCAGAGTGC | 38 | 1372 |
| 1101812 | N/A | N/A | 10505 | 10524 | CTTTCTCCTCCTTATATATT | 67 | 1373 |
| 1101813 | N/A | N/A | 10605 | 10624 | AAGTTTATCTTCAACTTTTC | 59 | 1374 |
| 1101814 | N/A | N/A | 10606 | 10625 | TAAGTTTATCTTCAACTTTT | 101 | 1375 |
| 1101815 | N/A | N/A | 10676 | 10695 | GTGAAAAAAATATGGGTTAT | 55 | 1376 |
| 1101816 | N/A | N/A | 10677 | 10696 | GGTGAAAAAAATATGGGTTA | 37 | 1377 |
| 1101817 | N/A | N/A | 10678 | 10697 | TGGTGAAAAAAATATGGGTT | 21 | 1378 |
| 1101818 | N/A | N/A | 10679 | 10698 | CTGGTGAAAAAAATATGGGT | 57 | 1379 |
| 1101819 | N/A | N/A | 10681 | 10700 | AGCTGGTGAAAAAAATATGG | 90 | 1380 |
| 1101820 | N/A | N/A | 10683 | 10702 | TCAGCTGGTGAAAAAAATAT | 93 | 1381 |
| 1101821 | N/A | N/A | 10694 | 10713 | AGGAGCAAAATTCAGCTGGT | 49 | 1382 |
| 1101822 | N/A | N/A | 10745 | 10764 | AAAGAGAACCACCTTGCAAG | 87 | 1383 |
| 1101823 | N/A | N/A | 10747 | 10766 | CTAAAGAGAACCACCTTGCA | 68 | 1384 |
| 1101824 | N/A | N/A | 10809 | 10828 | TTCCTTAACCCAACCTATCT | 107 | 1385 |
| 1101825 | N/A | N/A | 10810 | 10829 | ATTCCTTAACCCAACCTATC | 80 | 1386 |
| 1101826 | N/A | N/A | 10815 | 10834 | GGTCTATTCCTTAACCCAAC | 53 | 1387 |
| 1101827 | N/A | N/A | 10816 | 10835 | AGGTCTATTCCTTAACCCAA | 77 | 1388 |
| 1101828 | N/A | N/A | 10817 | 10836 | AAGGTCTATTCCTTAACCCA | 42 | 1389 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101829 | N/A | N/A | 10833 | 10852 | TCTCTCTTTCCCCAATAAGG | 75 | 1390 |
| 1101830 | N/A | N/A | 10872 | 10891 | AGAACATTTCCTTCTCCTGC | 66 | 1391 |
| 1101831 | N/A | N/A | 11044 | 11063 | TGAATCCAAGTCCAGGGTGC | 79 | 1392 |
| 1101832 | N/A | N/A | 11071 | 11090 | GGGCAGTTTCTCACACAACT | 48 | 1393 |
| 1101833 | N/A | N/A | 11185 | 11204 | CCTGGACAAGCCAGCAAGAG | 110 | 1394 |
| 1101835 | N/A | N/A | 11215 | 11234 | GAACTGTCCCAAACAACCCT | 66 | 1395 |
| 1101837 | N/A | N/A | 11258 | 11277 | GGAACTCTACAGATAATGTA | 66 | 1396 |
| 1101838 | N/A | N/A | 11303 | 11322 | GTTCCATGTTAAAACTTGCA | 146 | 1397 |
| 1101839 | N/A | N/A | 11308 | 11327 | ATTCTGTTCCATGTTAAAAC | 103 | 1398 |
| 1101840 | N/A | N/A | 11317 | 11336 | GTGAGAAAAATTCTGTTCCA | 55 | 1399 |
| 1101841 | N/A | N/A | 11320 | 11339 | CAGGTGAGAAAAATTCTGTT | 126 | 1400 |
| 1101842 | N/A | N/A | 11370 | 11389 | CACACAATCTAAATGCTTGT | 102 | 1401 |
| 1101843 | N/A | N/A | 11703 | 11722 | CATTTATTCTTTTAACATGA | 86 | 1402 |
| 1101844 | N/A | N/A | 11707 | 11726 | AGAACATTTATTCTTTTAAC | 106 | 1403 |
| 1101845 | N/A | N/A | 11711 | 11730 | CCCTAGAACATTTATTCTTT | 88 | 1404 |
| 1101846 | N/A | N/A | 11870 | 11889 | GAAAGGAAATTTTAGTCCCT | 48 | 1405 |
| 1101847 | N/A | N/A | 11879 | 11898 | ACTAATGGTGAAAGGAAATT | 89 | 1406 |
| 1101848 | N/A | N/A | 11887 | 11906 | AGTAAATTACTAATGGTGAA | 51 | 1407 |
| 1101849 | N/A | N/A | 11888 | 11907 | CAGTAAATTACTAATGGTGA | 63 | 1408 |
| 1101850 | N/A | N/A | 11889 | 11908 | ACAGTAAATTACTAATGGTG | 59 | 1409 |
| 1101851 | N/A | N/A | 11890 | 11909 | TACAGTAAATTACTAATGGT | 86 | 1410 |
| 1101852 | N/A | N/A | 11925 | 11944 | TTCAGTACCTAAAATAAGTT | 86 | 1411 |
| 1101853 | N/A | N/A | 11933 | 11952 | CCCTCATTTTCAGTACCTAA | 36 | 1412 |
| 1101854 | N/A | N/A | 11951 | 11970 | GTATAAAACATTTAGTCTCC | 49 | 1413 |
| 1101855 | N/A | N/A | 11952 | 11971 | TGTATAAAACATTTAGTCTC | 70 | 1414 |
| 1101856 | N/A | N/A | 11953 | 11972 | CTGTATAAAACATTTAGTCT | 82 | 1415 |
| 1101857 | N/A | N/A | 11954 | 11973 | ACTGTATAAAACATTTAGTC | 78 | 1416 |
| 1101858 | N/A | N/A | 11977 | 11996 | AATCTCATATTTTACTAAAA | 127 | 1417 |
| 1101859 | N/A | N/A | 11988 | 12007 | CAAATGCATCAAATCTCATA | 59 | 1418 |
| 1101860 | N/A | N/A | 11997 | 12016 | ATCATCTATCAAATGCATCA | 38 | 1419 |
| 1101861 | N/A | N/A | 12011 | 12030 | TATTTTAAACAAACATCATC | 107 | 1420 |
| 1101862 | N/A | N/A | 12016 | 12035 | AGAATTATTTTAAACAAACA | 102 | 1421 |
| 1101863 | N/A | N/A | 12017 | 12036 | AAGAATTATTTTAAACAAAC | 87 | 1422 |
| 1101864 | N/A | N/A | 12027 | 12046 | TCAAAAATTTAAGAATTATT | 80 | 1423 |
| 1101865 | N/A | N/A | 12028 | 12047 | ATCAAAAATTTAAGAATTAT | 130 | 1424 |
| 1101866 | N/A | N/A | 12030 | 12049 | TGATCAAAAATTTAAGAATT | 73 | 1425 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101867 | N/A | N/A | 12031 | 12050 | ATGATCAAAAATTTAAGAAT | 135 | 1426 |
| 1101868 | N/A | N/A | 12032 | 12051 | CATGATCAAAAATTTAAGAA | 87 | 1427 |
| 1101869 | N/A | N/A | 12034 | 12053 | TACATGATCAAAAATTTAAG | 120 | 1428 |
| 1101871 | N/A | N/A | 12050 | 12069 | TTAATGAAACTATAATTACA | 96 | 1429 |
| 1101873 | N/A | N/A | 12092 | 12111 | CATGCATTTTCATTTGGTAA | 21 | 1430 |
| 1101874 | N/A | N/A | 12137 | 12156 | TTGAACTGAACTTTCAGCTT | 60 | 1431 |
| 1101875 | N/A | N/A | 12268 | 12287 | ATACGGTTTCACAATGTTAG | 42 | 1432 |
| 1101876 | N/A | N/A | 12770 | 12789 | CTAAATAATTTAATCATTAA | 91 | 1433 |
| 1101877 | N/A | N/A | 12772 | 12791 | CCCTAAATAATTTAATCATT | 104 | 1434 |
| 1101878 | N/A | N/A | 12774 | 12793 | TCCCCTAAATAATTTAATCA | 128 | 1435 |
| 1101879 | N/A | N/A | 12778 | 12797 | CGGCTCCCCTAAATAATTTA | 81 | 1436 |
| 1101880 | N/A | N/A | 13087 | 13106 | ATCTTCCCCTAAATAATTTT | 82 | 1437 |
| 1101881 | N/A | N/A | 13129 | 13148 | AGAAAAAATTAAAATGTGAC | 106 | 1438 |
| 1101882 | N/A | N/A | 13145 | 13164 | TGCTAATATTTCCAAAAGAA | 75 | 1439 |
| 1101883 | N/A | N/A | 13146 | 13165 | TTGCTAATATTTCCAAAAGA | 61 | 1440 |
| 1101884 | N/A | N/A | 13159 | 13178 | AAAGTGAGCCTTCTTGCTAA | 74 | 1441 |
| 1101885 | N/A | N/A | 13328 | 13347 | AGTGAGTTTAAAATCAGTAC | 76 | 1442 |
| 1101886 | N/A | N/A | 13329 | 13348 | TAGTGAGTTTAAAATCAGTA | 84 | 1443 |
| 1101887 | N/A | N/A | 13664 | 13683 | TATCCACATTTTTAAAAGAA | 91 | 1444 |
| 1101888 | N/A | N/A | 13709 | 13728 | CAGTCAGATCCCTATAGGAA | 31 | 1445 |
| 1101889 | N/A | N/A | 13714 | 13733 | TTCACCAGTCAGATCCCTAT | 50 | 1446 |
| 1101890 | N/A | N/A | 13718 | 13737 | ATAATTCACCAGTCAGATCC | 59 | 1447 |
| 1101891 | N/A | N/A | 13720 | 13739 | TTATAATTCACCAGTCAGAT | 53 | 1448 |
| 1101892 | N/A | N/A | 13721 | 13740 | GTTATAATTCACCAGTCAGA | 44 | 1449 |
| 1101893 | N/A | N/A | 13722 | 13741 | AGTTATAATTCACCAGTCAG | 46 | 1450 |
| 1101894 | N/A | N/A | 13723 | 13742 | CAGTTATAATTCACCAGTCA | 50 | 1451 |
| 1101895 | N/A | N/A | 13724 | 13743 | ACAGTTATAATTCACCAGTC | 47 | 1452 |
| 1101896 | N/A | N/A | 13746 | 13765 | TCCCATTTCCAAAGTTAACA | 62 | 1453 |
| 1101897 | N/A | N/A | 13775 | 13794 | GTGCATATTTAAAACAATAT | 110 | 1454 |
| 1101898 | N/A | N/A | 13796 | 13815 | AGGATACAAACTGTCATTAG | 141 | 1455 |
| 1101899 | N/A | N/A | 13799 | 13818 | AGAAGGATACAAACTGTCAT | 106 | 1456 |
| 1101900 | N/A | N/A | 13844 | 13863 | CTGTTAATTTTGACAGGTAG | 65 | 1457 |
| 1101901 | N/A | N/A | 13847 | 13866 | CTGCTGTTAATTTTGACAGG | 96 | 1458 |
| 1101902 | N/A | N/A | 13899 | 13918 | GACTACTTACCTGAATAGAG | 84 | 1459 |
| 1101903 | N/A | N/A | 13904 | 13923 | CTTGTGACTACTTACCTGAA | 97 | 1460 |
| 1101904 | N/A | N/A | 13926 | 13945 | TGTAAGCAACACATAGTACA | 98 | 1461 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101905 | N/A | N/A | 14015 | 14034 | GAGTATAATCTATACTCTGT | 131 | 1462 |
| 1101907 | N/A | N/A | 14331 | 14350 | TATATAAAAATCTAGTACTC | 111 | 1463 |
| 1101909 | N/A | N/A | 14334 | 14353 | ATCTATATAAAAATCTAGTA | 75 | 1464 |
| 1101910 | N/A | N/A | 14335 | 14354 | TATCTATATAAAAATCTAGT | 96 | 1465 |
| 1101911 | N/A | N/A | 14343 | 14362 | TTCATGTTTATCTATATAAA | 82 | 1466 |
| 1101912 | N/A | N/A | 14350 | 14369 | CAATCCTTTCATGTTTATCT | 25 | 1467 |
| 1101913 | N/A | N/A | 14354 | 14373 | TCTACAATCCTTTCATGTTT | 47 | 1468 |
| 1101914 | N/A | N/A | 14355 | 14374 | TTCTACAATCCTTTCATGTT | 43 | 1469 |
| 1101915 | N/A | N/A | 14356 | 14375 | ATTCTACAATCCTTTCATGT | 41 | 1470 |
| 1101916 | N/A | N/A | 14389 | 14408 | AGGAATTTTTAAATGCCCCA | 48 | 1471 |
| 1101917 | N/A | N/A | 14390 | 14409 | AAGGAATTTTTAAATGCCCC | 104 | 1472 |
| 1101918 | N/A | N/A | 14391 | 14410 | GAAGGAATTTTTAAATGCCC | 20 | 1473 |
| 1101919 | N/A | N/A | 14392 | 14411 | AGAAGGAATTTTTAAATGCC | 52 | 1474 |
| 1101920 | N/A | N/A | 14434 | 14453 | TAAGGTTATTATTAGCATCC | 8 | 1475 |
| 1101921 | N/A | N/A | 14436 | 14455 | ATTAAGGTTATTATTAGCAT | 89 | 1476 |
| 1101922 | N/A | N/A | 14792 | 14811 | CTCAAATTTACCCAACAGAT | 96 | 1477 |
| 1101923 | N/A | N/A | 14796 | 14815 | TTTTCTCAAATTTACCCAAC | 77 | 1478 |
| 1101924 | N/A | N/A | 14830 | 14849 | GGCTGATTTAAAAGGATGGT | 48 | 1479 |
| 1101925 | N/A | N/A | 14831 | 14850 | AGGCTGATTTAAAAGGATGG | 57 | 1480 |
| 1101926 | N/A | N/A | 14834 | 14853 | GGTAGGCTGATTTAAAAGGA | 25 | 1481 |
| 1101927 | N/A | N/A | 14849 | 14868 | AAGGAAATCCAGTCTGGTAG | 27 | 1482 |
| 1101928 | N/A | N/A | 14851 | 14870 | ATAAGGAAATCCAGTCTGGT | 78 | 1483 |
| 1101929 | N/A | N/A | 14864 | 14883 | GCCACAAACCATAATAAGGA | 56 | 1484 |
| 1101930 | N/A | N/A | 14873 | 14892 | AAATCAAAAGCCACAAACCA | 73 | 1485 |
| 1101931 | N/A | N/A | 14895 | 14914 | AGAGCTATACATTAAAAAAA | 69 | 1486 |
| 1101932 | N/A | N/A | 14909 | 14928 | CAAAGAATTCAAAGAGAGCT | 89 | 1487 |
| 1101933 | N/A | N/A | 14914 | 14933 | ACCACCAAAGAATTCAAAGA | 119 | 1488 |
| 1101934 | N/A | N/A | 14918 | 14937 | TATAACCACCAAAGAATTCA | 81 | 1489 |
| 1101935 | N/A | N/A | 14921 | 14940 | ATATATAACCACCAAAGAAT | 84 | 1490 |
| 1101936 | N/A | N/A | 14923 | 14942 | ATATATATAACCACCAAAGA | 95 | 1491 |
| 1101937 | N/A | N/A | 14928 | 14947 | TACATATATATATAACCACC | 71 | 1492 |
| 1101938 | N/A | N/A | 14930 | 14949 | AGTACATATATATATAACCA | 96 | 1493 |
| 1101939 | N/A | N/A | 14949 | 14968 | CAGATAAAAGAATCTTGCGA | 84 | 1494 |
| 1101940 | N/A | N/A | 14972 | 14991 | TTAGAAAAAGAATGAAAGAC | 27 | 1495 |
| 1101941 | N/A | N/A | 14991 | 15010 | CTGGATACAACTCACAGTGT | 63 | 1496 |
| 1101943 | N/A | N/A | 15141 | 15160 | TGCAGTAGCCATTACCTGTT | 87 | 1497 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101945 | N/A | N/A | 15217 | 15236 | AACAGGCACCAAGAGCAGCA | 82 | 1498 |
| 1101946 | N/A | N/A | 15292 | 15311 | GGTAGCCAACAAAGAAGCAA | 64 | 1499 |
| 1101947 | N/A | N/A | 15295 | 15314 | CAAGGTAGCCAACAAAGAAG | 85 | 1500 |
| 1101948 | N/A | N/A | 15297 | 15316 | TCCAAGGTAGCCAACAAAGA | 72 | 1501 |
| 1101949 | N/A | N/A | 15318 | 15337 | CTGAAAATTCACTATCTGCC | 67 | 1502 |
| 1101950 | N/A | N/A | 15321 | 15340 | TTTCTGAAAATTCACTATCT | 79 | 1503 |
| 1101951 | N/A | N/A | 15324 | 15343 | AAATTTCTGAAAATTCACTA | 76 | 1504 |
| 1101952 | N/A | N/A | 15367 | 15386 | AAATGCAAACCTGTTTATTT | 68 | 1505 |
| 1101953 | N/A | N/A | 15441 | 15460 | CTGGGCATTTAAACTGAAGG | 72 | 1506 |
| 1101954 | N/A | N/A | 15461 | 15480 | TCTACCAAAATAAGTTCTCC | 99 | 1507 |
| 1101955 | N/A | N/A | 15465 | 15484 | CATATCTACCAAAATAAGTT | 76 | 1508 |
| 1101956 | N/A | N/A | 15503 | 15522 | AAAATTATATTCAACTTGCT | 93 | 1509 |
| 1101957 | N/A | N/A | 15519 | 15538 | TGGGTGCTACTTTAGAAAAA | 58 | 1510 |
| 1101958 | N/A | N/A | 15552 | 15571 | GTCTACTATATACATCTGAT | 48 | 1511 |
| 1101959 | N/A | N/A | 15555 | 15574 | CTAGTCTACTATATACATCT | 59 | 1512 |
| 1101960 | N/A | N/A | 15556 | 15575 | ACTAGTCTACTATATACATC | 77 | 1513 |
| 1101961 | N/A | N/A | 15561 | 15580 | TTAAAACTAGTCTACTATAT | 85 | 1514 |
| 1101962 | N/A | N/A | 15585 | 15604 | ATATTCTACCCATAAGTGCT | 34 | 1515 |
| 1101963 | N/A | N/A | 15588 | 15607 | TGTATATTCTACCCATAAGT | 66 | 1516 |
| 1101964 | N/A | N/A | 15601 | 15620 | TCAAAAATCCAGATGTATAT | 98 | 1517 |
| 1101965 | N/A | N/A | 15603 | 15622 | CCTCAAAAATCCAGATGTAT | 82 | 1518 |
| 1101966 | N/A | N/A | 15604 | 15623 | GCCTCAAAAATCCAGATGTA | 98 | 1519 |
| 1101967 | N/A | N/A | 15624 | 15643 | CACAATTCCTAAATAAAACT | 106 | 1520 |
| 1101968 | N/A | N/A | 15626 | 15645 | CACACAATTCCTAAATAAAA | 89 | 1521 |
| 1101969 | N/A | N/A | 15635 | 15654 | CCAGAAAACCACACAATTCC | 87 | 1522 |
| 1101970 | N/A | N/A | 15636 | 15655 | TCCAGAAAACCACACAATTC | 83 | 1523 |
| 1101971 | N/A | N/A | 15637 | 15656 | TTCCAGAAAACCACACAATT | 79 | 1524 |
| 1101972 | N/A | N/A | 15640 | 15659 | ATGTTCCAGAAAACCACACA | 66 | 1525 |
| 1101973 | N/A | N/A | 15643 | 15662 | GAGATGTTCCAGAAAACCAC | 43 | 1526 |
| 1101974 | N/A | N/A | 15666 | 15685 | AGTGCTTTTCATACCAGGTC | 6 | 1527 |
| 1101975 | N/A | N/A | 15667 | 15686 | GAGTGCTTTTCATACCAGGT | 6 | 1528 |
| 1101976 | N/A | N/A | 15704 | 15723 | CACTAAATCCATAAAAAAAA | 110 | 1529 |
| 1101977 | N/A | N/A | 15706 | 15725 | ATCACTAAATCCATAAAAAA | 101 | 1530 |
| 1101979 | N/A | N/A | 15712 | 15731 | AGATATATCACTAAATCCAT | 51 | 1531 |
| 1101981 | N/A | N/A | 15714 | 15733 | ATAGATATATCACTAAATCC | 63 | 1532 |
| 1101982 | N/A | N/A | 15715 | 15734 | TATAGATATATCACTAAATC | 103 | 1533 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101983 | N/A | N/A | 15719 | 15738 | TGTGTATAGATATATCACTA | 76 | 1534 |
| 1101984 | N/A | N/A | 15720 | 15739 | GTGTGTATAGATATATCACT | 54 | 1535 |
| 1101985 | N/A | N/A | 15739 | 15758 | TATAGGTTTTAAAAAGTGTG | 42 | 1536 |
| 1101986 | N/A | N/A | 16063 | 16082 | TATAAATTTCTCTAGAAGGC | 58 | 1537 |
| 1101987 | N/A | N/A | 16064 | 16083 | ATATAAATTTCTCTAGAAGG | 78 | 1538 |
| 1101988 | N/A | N/A | 16068 | 16087 | TCATATATAAATTTCTCTAG | 102 | 1539 |
| 1101989 | N/A | N/A | 16110 | 16129 | CCATTCCAAATTTAGGAAGT | 74 | 1540 |
| 1101990 | N/A | N/A | 16113 | 16132 | ACTCCATTCCAAATTTAGGA | 60 | 1541 |
| 1101991 | N/A | N/A | 16136 | 16155 | AGCAACTTTTCATAAGCTAA | 75 | 1542 |
| 1101992 | N/A | N/A | 16160 | 16179 | TGCTTATAACCTGTTAAGAA | 28 | 1543 |
| 1101993 | N/A | N/A | 16258 | 16277 | GAAATGCAAAACAGAATCTT | 70 | 1544 |
| 1101994 | N/A | N/A | 16297 | 16316 | TTACAACTTTAAAAATCAAA | 72 | 1545 |
| 1101995 | N/A | N/A | 16306 | 16325 | TTTAAGAAATTACAACTTTA | 89 | 1546 |
| 1101996 | N/A | N/A | 16330 | 16349 | AGTATTCAAAATGTATTTCT | 80 | 1547 |
| 1101997 | N/A | N/A | 16345 | 16364 | GAACATCAAAACAAAAGTAT | 86 | 1548 |
| 1101998 | N/A | N/A | 16385 | 16404 | CACAAAGGTGAAATAGGAAA | 66 | 1549 |
| 1101999 | N/A | N/A | 16529 | 16548 | ATCACACAACCATATGAACG | 70 | 1550 |
| 1102000 | N/A | N/A | 16538 | 16557 | TTTTAAAAGATCACACAACC | 86 | 1551 |
| 1102001 | N/A | N/A | 16540 | 16559 | GTTTTTAAAAGATCACACAA | 60 | 1552 |
| 1102002 | N/A | N/A | 16543 | 16562 | GATGTTTTTAAAAGATCACA | 61 | 1553 |
| 1102003 | N/A | N/A | 16546 | 16565 | ACTGATGTTTTTAAAAGATC | 45 | 1554 |
| 1102004 | N/A | N/A | 16547 | 16566 | CACTGATGTTTTTAAAAGAT | 53 | 1555 |
| 1102005 | N/A | N/A | 16571 | 16590 | AAGATTATATTTATAGTTAA | 121 | 1556 |
| 1102006 | N/A | N/A | 16572 | 16591 | TAAGATTATATTTATAGTTA | 94 | 1557 |
| 1102007 | N/A | N/A | 16581 | 16600 | GTGATAATTTAAGATTATAT | 51 | 1558 |
| 1102008 | N/A | N/A | 16584 | 16603 | TTTGTGATAATTTAAGATTA | 125 | 1559 |
| 1102009 | N/A | N/A | 16588 | 16607 | AAAATTTGTGATAATTTAAG | 136 | 1560 |
| 1102010 | N/A | N/A | 16601 | 16620 | GCAAATATTATATAAAATTT | 85 | 1561 |
| 1102011 | N/A | N/A | 16603 | 16622 | TGGCAAATATTATATAAAAT | 84 | 1562 |
| 1102012 | N/A | N/A | 16627 | 16646 | TGAATTCATATTTATGTTGT | 54 | 1563 |
| 1102013 | N/A | N/A | 16637 | 16656 | CTTGAAATATTGAATTCATA | 85 | 1564 |
| 1102015 | N/A | N/A | 16655 | 16674 | GAAAACAGACAATATTAACT | 89 | 1565 |
| 1102017 | N/A | N/A | 16680 | 16699 | TAAATGATCTTTCATTTCTA | 57 | 1566 |
| 1102018 | N/A | N/A | 16732 | 16751 | ACCTGTTTTCCTAATTTTCT | 68 | 1567 |
| 1102019 | N/A | N/A | 16748 | 16767 | AAGGGTAAGAAATGTTACCT | 113 | 1568 |
| 1102020 | N/A | N/A | 16768 | 16787 | TATAAGAAAAAAAGACAAGG | 114 | 1569 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102021 | N/A | N/A | 16771 | 16790 | CAATATAAGAAAAAAAGACA | 85 | 1570 |
| 1102022 | N/A | N/A | 16800 | 16819 | TGGCCCACATTTTAGTTTTA | 91 | 1571 |
| 1102023 | N/A | N/A | 17168 | 17187 | AATTTTAAAGTCAGCAATCC | 43 | 1572 |
| 1102024 | N/A | N/A | 17172 | 17191 | TCCTAATTTTAAAGTCAGCA | 8 | 1573 |
| 1102025 | N/A | N/A | 17173 | 17192 | TTCCTAATTTTAAAGTCAGC | 102 | 1574 |
| 1102026 | N/A | N/A | 17174 | 17193 | TTTCCTAATTTTAAAGTCAG | 88 | 1575 |
| 1102027 | N/A | N/A | 17175 | 17194 | GTTTCCTAATTTTAAAGTCA | 26 | 1576 |
| 1102028 | N/A | N/A | 17180 | 17199 | GGTCAGTTTCCTAATTTTAA | 4 | 1577 |
| 1102029 | N/A | N/A | 17237 | 17256 | AATGACAATTTCTATCTATC | 64 | 1578 |
| 1102030 | N/A | N/A | 17252 | 17271 | GATATTATCTTTTAAAATGA | 88 | 1579 |
| 1102031 | N/A | N/A | 17277 | 17296 | CACAAATAAATTTATAAGGA | 108 | 1580 |
| 1102032 | N/A | N/A | 17283 | 17302 | ACTTGTCACAAATAAATTTA | 113 | 1581 |
| 1102033 | N/A | N/A | 17284 | 17303 | TACTTGTCACAAATAAATTT | 77 | 1582 |
| 1102034 | N/A | N/A | 17300 | 17319 | ATAGTTAAATTGCATATACT | 57 | 1583 |
| 1102035 | N/A | N/A | 17304 | 17323 | TGATATAGTTAAATTGCATA | 51 | 1584 |
| 1102036 | N/A | N/A | 17312 | 17331 | TTTTCTTATGATATAGTTAA | 70 | 1585 |
| 1102037 | N/A | N/A | 17318 | 17337 | TAGAATTTTTCTTATGATAT | 78 | 1586 |
| 1102038 | N/A | N/A | 17319 | 17338 | ATAGAATTTTTCTTATGATA | 83 | 1587 |
| 1102039 | N/A | N/A | 17323 | 17342 | TAATATAGAATTTTTCTTAT | 94 | 1588 |
| 1102040 | N/A | N/A | 17335 | 17354 | TTGTATTATCTTTAATATAG | 66 | 1589 |
| 1102041 | N/A | N/A | 17365 | 17384 | ACATAAAAACCCACTTAAAA | 89 | 1590 |
| 1102042 | N/A | N/A | 17369 | 17388 | CATCACATAAAAACCCACTT | 59 | 1591 |
| 1102043 | N/A | N/A | 17378 | 17397 | GAACATAGTCATCACATAAA | 25 | 1592 |
| 1102044 | N/A | N/A | 17380 | 17399 | CAGAACATAGTCATCACATA | 47 | 1593 |
| 1102045 | N/A | N/A | 17417 | 17436 | TGCTAAATACAAATCTATAA | 97 | 1594 |
| 1102046 | N/A | N/A | 17419 | 17438 | TATGCTAAATACAAATCTAT | 116 | 1595 |
| 1102047 | N/A | N/A | 17420 | 17439 | CTATGCTAAATACAAATCTA | 94 | 1596 |
| 1102048 | N/A | N/A | 17421 | 17440 | ACTATGCTAAATACAAATCT | 70 | 1597 |
| 1102049 | N/A | N/A | 17446 | 17465 | ACACTATTTCAGGCTTTGTG | 15 | 1598 |
| 1102051 | N/A | N/A | 17464 | 17483 | ATGCTTTATTCATGCTTGAC | 29 | 1599 |
| 1102053 | N/A | N/A | 17494 | 17513 | ATAATCTTACACTAAAGCAA | 85 | 1600 |
| 1102054 | N/A | N/A | 17497 | 17516 | TGAATAATCTTACACTAAAG | 86 | 1601 |
| 1102055 | N/A | N/A | 17498 | 17517 | ATGAATAATCTTACACTAAA | 81 | 1602 |
| 1102056 | N/A | N/A | 17505 | 17524 | AATCATAATGAATAATCTTA | 85 | 1603 |
| 1102057 | N/A | N/A | 17576 | 17595 | AGACATATTTCATGTTTTAT | 40 | 1604 |
| 1102058 | N/A | N/A | 17577 | 17596 | AAGACATATTTCATGTTTTA | 64 | 1605 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102059 | N/A | N/A | 17578 | 17597 | CAAGACATATTTCATGTTTT | 56 | 1606 |
| 1102060 | N/A | N/A | 17583 | 17602 | TTGCTCAAGACATATTTCAT | 30 | 1607 |
| 1102061 | N/A | N/A | 17584 | 17603 | CTTGCTCAAGACATATTTCA | 84 | 1608 |
| 1102062 | N/A | N/A | 17599 | 17618 | TGTTTCTTAAAATAGCTTGC | 33 | 1609 |
| 1102063 | N/A | N/A | 17632 | 17651 | TTCAAAATTCTAATAACAAG | 104 | 1610 |
| 1102064 | N/A | N/A | 17635 | 17654 | AGATTCAAAATTCTAATAAC | 121 | 1611 |
| 1102065 | N/A | N/A | 17644 | 17663 | CTCTTTCAAAGATTCAAAAT | 72 | 1612 |
| 1102066 | N/A | N/A | 17647 | 17666 | ACCCTCTTTCAAAGATTCAA | 64 | 1613 |
| 1102067 | N/A | N/A | 17654 | 17673 | TTCAATAACCCTCTTTCAAA | 89 | 1614 |
| 1102068 | N/A | N/A | 17779 | 17798 | TAAATGATACCATACAGCAG | 69 | 1615 |
| 1102069 | N/A | N/A | 17783 | 17802 | TTAATAAATGATACCATACA | 79 | 1616 |
| 1102070 | N/A | N/A | 17794 | 17813 | TTTCTAGACTTTTAATAAAT | 91 | 1617 |
| 1102071 | N/A | N/A | 17941 | 17960 | TACTACAACCAAGATAGTGA | 93 | 1618 |
| 1102072 | N/A | N/A | 17963 | 17982 | TACTGTACTCCCATGAAACC | 61 | 1619 |
| 1102073 | N/A | N/A | 17971 | 17990 | CATTTGTATACTGTACTCCC | 28 | 1620 |
| 1102074 | N/A | N/A | 18368 | 18387 | TTGGCTTGTATTTACATTTT | 6 | 1621 |
| 1102075 | N/A | N/A | 18406 | 18425 | AGATTTAATTCAATATATTT | 79 | 1622 |
| 1102076 | N/A | N/A | 18413 | 18432 | CTCTTACAGATTTAATTCAA | 49 | 1623 |
| 1102077 | N/A | N/A | 18427 | 18446 | TGTTTTTGAATTATCTCTTA | 19 | 1624 |
| 1102078 | N/A | N/A | 18448 | 18467 | AAAAGATAACAATAGGGTTT | 53 | 1625 |
| 1102079 | N/A | N/A | 18449 | 18468 | TAAAAGATAACAATAGGGTT | 57 | 1626 |
| 1102080 | N/A | N/A | 18452 | 18471 | ACTTAAAAGATAACAATAGG | 85 | 1627 |
| 1102081 | N/A | N/A | 18454 | 18473 | TGACTTAAAAGATAACAATA | 88 | 1628 |
| 1102082 | N/A | N/A | 18458 | 18477 | TGGGTGACTTAAAAGATAAC | 81 | 1629 |
| 1102083 | N/A | N/A | 18461 | 18480 | ATTTGGGTGACTTAAAAGAT | 83 | 1630 |
| 1102084 | N/A | N/A | 18478 | 18497 | GACTTTTCCCAAATTTGATT | 11 | 1631 |
| 1102085 | N/A | N/A | 18480 | 18499 | GTGACTTTTCCCAAATTTGA | 18 | 1632 |
| 1102087 | N/A | N/A | 18833 | 18852 | TTAAGAAAGAACCAACTTAG | 92 | 1633 |
| 1102089 | N/A | N/A | 18844 | 18863 | CAGGAAGAACTTTAAGAAAG | 52 | 1634 |
| 1102090 | N/A | N/A | 18875 | 18894 | GTTACATCTCCTTAACTTGC | 14 | 1635 |
| 1102091 | N/A | N/A | 18903 | 18922 | CCAGCTAGCCTCCACTGTAA | 76 | 1636 |
| 1102092 | N/A | N/A | 18905 | 18924 | ACCCAGCTAGCCTCCACTGT | 168 | 1637 |
| 1102093 | N/A | N/A | 19119 | 19138 | TTAAATAATCTCAGCAGTAC | 43 | 1638 |
| 1102094 | N/A | N/A | 19123 | 19142 | GAGGTTAAATAATCTCAGCA | 82 | 1639 |
| 1102095 | N/A | N/A | 19124 | 19143 | AGAGGTTAAATAATCTCAGC | 67 | 1640 |
| 1102096 | N/A | N/A | 19125 | 19144 | CAGAGGTTAAATAATCTCAG | 95 | 1641 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102097 | N/A | N/A | 19126 | 19145 | CCAGAGGTTAAATAATCTCA | 98 | 1642 |
| 1102098 | N/A | N/A | 19127 | 19146 | CCCAGAGGTTAAATAATCTC | 69 | 1643 |
| 1102099 | N/A | N/A | 19135 | 19154 | AAATAAAACCCAGAGGTTAA | 79 | 1644 |
| 1102100 | N/A | N/A | 19136 | 19155 | TAAATAAAACCCAGAGGTTA | 81 | 1645 |
| 1102101 | N/A | N/A | 19137 | 19156 | ATAAATAAAACCCAGAGGTT | 85 | 1646 |
| 1102102 | N/A | N/A | 19192 | 19211 | GCTTACTTTATACAAAAAAA | 65 | 1647 |
| 1102103 | N/A | N/A | 19194 | 19213 | GTGCTTACTTTATACAAAAA | 17 | 1648 |
| 1102104 | N/A | N/A | 19196 | 19215 | CAGTGCTTACTTTATACAAA | 4 | 1649 |
| 1102105 | N/A | N/A | 19207 | 19226 | CCTTAAAAATTCAGTGCTTA | 31 | 1650 |
| 1102106 | N/A | N/A | 19208 | 19227 | ACCTTAAAAATTCAGTGCTT | 29 | 1651 |
| 1102107 | N/A | N/A | 19216 | 19235 | TTAATACAACCTTAAAAATT | 87 | 1652 |
| 1102108 | N/A | N/A | 19222 | 19241 | TGCAAATTAATACAACCTTA | 17 | 1653 |
| 1102109 | N/A | N/A | 19232 | 19251 | GACATTTATTTGCAAATTAA | 30 | 1654 |
| 1102110 | N/A | N/A | 19238 | 19257 | AAGATAGACATTTATTTGCA | 12 | 1655 |
| 1102111 | N/A | N/A | 19239 | 19258 | TAAGATAGACATTTATTTGC | 27 | 1656 |
| 1102112 | N/A | N/A | 19241 | 19260 | AATAAGATAGACATTTATTT | 112 | 1657 |
| 1102113 | N/A | N/A | 19246 | 19265 | AAAATAATAAGATAGACATT | 100 | 1658 |
| 1102114 | N/A | N/A | 19249 | 19268 | CTCAAAATAATAAGATAGAC | 108 | 1659 |
| 1102115 | N/A | N/A | 19250 | 19269 | TCTCAAAATAATAAGATAGA | 71 | 1660 |
| 1102116 | N/A | N/A | 19251 | 19270 | CTCTCAAAATAATAAGATAG | 100 | 1661 |
| 1102117 | N/A | N/A | 19265 | 19284 | AAAATTTTTAAATCTCTCA | 97 | 1662 |
| 1102118 | N/A | N/A | 19296 | 19315 | TCAAAATGTGAAAATGCAAT | 81 | 1663 |
| 1102119 | N/A | N/A | 19340 | 19359 | AACCAAAATTTGACATCTTC | 23 | 1664 |
| 1102120 | N/A | N/A | 19343 | 19362 | ATAAACCAAAATTTGACATC | 75 | 1665 |
| 1102121 | N/A | N/A | 19346 | 19365 | AAAATAAACCAAAATTTGAC | 126 | 1666 |
| 1102123 | N/A | N/A | 19393 | 19412 | ATAGTGAAAAATATAGTTTT | 91 | 1667 |
| 1102125 | N/A | N/A | 19395 | 19414 | CTATAGTGAAAAATATAGTT | 92 | 1668 |
| 1102126 | N/A | N/A | 19397 | 19416 | GTCTATAGTGAAAAATATAG | 90 | 1669 |
| 1102127 | N/A | N/A | 19430 | 19449 | TTCATTATACAGGGACCTCG | 60 | 1670 |
| 1102128 | N/A | N/A | 19437 | 19456 | CTTCTTTTTCATTATACAGG | 11 | 1671 |
| 1102129 | N/A | N/A | 19453 | 19472 | TAATACTTTTTCCAGCCTTC | 17 | 1672 |
| 1102130 | N/A | N/A | 19455 | 19474 | GTTAATACTTTTTCCAGCCT | 9 | 1673 |
| 1102131 | N/A | N/A | 19457 | 19476 | ATGTTAATACTTTTTCCAGC | 10 | 1674 |
| 1102132 | N/A | N/A | 19458 | 19477 | AATGTTAATACTTTTTCCAG | 63 | 1675 |
| 1102133 | N/A | N/A | 19460 | 19479 | ACAATGTTAATACTTTTTCC | 108 | 1676 |
| 1102134 | N/A | N/A | 19468 | 19487 | GGATTTTGACAATGTTAATA | 20 | 1677 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102135 | N/A | N/A | 19498 | 19517 | CGATCAATATCATGACCAAC | 46 | 1678 |
| 1102136 | N/A | N/A | 19517 | 19536 | AAAAAGTTTCTAAAGTTAAC | 187 | 1679 |
| 1102137 | N/A | N/A | 19527 | 19546 | CACAAGATACAAAAAGTTTC | 107 | 1680 |
| 1102138 | N/A | N/A | 19530 | 19549 | ACCCACAAGATACAAAAAGT | 87 | 1681 |
| 1102139 | N/A | N/A | 19531 | 19550 | AACCCACAAGATACAAAAAG | 101 | 1682 |
| 1102140 | N/A | N/A | 19532 | 19551 | TAACCCACAAGATACAAAAA | 88 | 1683 |
| 1102141 | N/A | N/A | 19537 | 19556 | TAATTTAACCCACAAGATAC | 65 | 1684 |
| 1102142 | N/A | N/A | 19538 | 19557 | CTAATTTAACCCACAAGATA | 75 | 1685 |
| 1102143 | N/A | N/A | 19542 | 19561 | AATCCTAATTTAACCCACAA | 58 | 1686 |
| 1102144 | N/A | N/A | 19544 | 19563 | GTAATCCTAATTTAACCCAC | 39 | 1687 |
| 1102145 | N/A | N/A | 19548 | 19567 | CATAGTAATCCTAATTTAAC | 94 | 1688 |
| 1102146 | N/A | N/A | 19564 | 19583 | TCATTTATCACTACCACATA | 64 | 1689 |
| 1102147 | N/A | N/A | 19567 | 19586 | ACATCATTTATCACTACCAC | 27 | 1690 |
| 1102148 | N/A | N/A | 19571 | 19590 | ATTAACATCATTTATCACTA | 80 | 1691 |
| 1102149 | N/A | N/A | 19574 | 19593 | CTAATTAACATCATTTATCA | 109 | 1692 |
| 1102150 | N/A | N/A | 19575 | 19594 | CCTAATTAACATCATTTATC | 88 | 1693 |
| 1102151 | N/A | N/A | 19576 | 19595 | CCCTAATTAACATCATTTAT | 91 | 1694 |
| 1102152 | N/A | N/A | 19577 | 19596 | GCCCTAATTAACATCATTTA | 88 | 1695 |
| 1102153 | N/A | N/A | 19579 | 19598 | CGGCCCTAATTAACATCATT | 118 | 1696 |
| 1102154 | N/A | N/A | 19580 | 19599 | TCGGCCCTAATTAACATCAT | 76 | 1697 |
| 1102155 | N/A | N/A | 19581 | 19600 | CTCGGCCCTAATTAACATCA | 88 | 1698 |
| 1102156 | N/A | N/A | 19585 | 19604 | TGCACTCGGCCCTAATTAAC | 55 | 1699 |
| 1102157 | N/A | N/A | 19685 | 19704 | GGTCTTACACTATGTTGTAC | 73 | 1700 |
| 1102159 | N/A | N/A | 19881 | 19900 | CACATATAACATATAAACAC | 99 | 1701 |
| 1102161 | N/A | N/A | 19883 | 19902 | ATCACATATAACATATAAAC | 108 | 1702 |
| 1102162 | N/A | N/A | 19887 | 19906 | CACTATCACATATAACATAT | 45 | 1703 |
| 1102163 | N/A | N/A | 19918 | 19937 | GTCTCTATAATTTAAAAATG | 95 | 1704 |
| 1102164 | N/A | N/A | 20063 | 20082 | CAGCTCAGTTTTTAAAAATC | 55 | 1705 |
| 1102165 | N/A | N/A | 20074 | 20093 | TTTATAATTACCAGCTCAGT | 36 | 1706 |
| 1102166 | N/A | N/A | 20077 | 20096 | GAATTTATAATTACCAGCTC | 23 | 1707 |
| 1102167 | N/A | N/A | 20084 | 20103 | AGGAAGAGAATTTATAATTA | 98 | 1708 |
| 1102168 | N/A | N/A | 20105 | 20124 | TGTGAGAAAGTCAGAAGTTC | 61 | 1709 |
| 1102169 | N/A | N/A | 20122 | 20141 | TGTCAAAAGATTCCAATTGT | 118 | 1710 |
| 1102170 | N/A | N/A | 20124 | 20143 | TTTGTCAAAAGATTCCAATT | 77 | 1711 |
| 1102171 | N/A | N/A | 20128 | 20147 | AATTTTTGTCAAAAGATTCC | 68 | 1712 |
| 1102172 | N/A | N/A | 20147 | 20166 | AAGTTTTCCCATTACTGATA | 49 | 1713 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102173 | N/A | N/A | 20163 | 20182 | AAATGACAACTACACAAAGT | 96 | 1714 |
| 1102174 | N/A | N/A | 20204 | 20223 | CAACATAACTCCAATCATAT | 97 | 1715 |
| 1102175 | N/A | N/A | 20222 | 20241 | TTTTTCAAAATATCAGTCCA | 45 | 1716 |
| 1102176 | N/A | N/A | 20223 | 20242 | TTTTTTCAAAATATCAGTCC | 55 | 1717 |
| 1102177 | N/A | N/A | 20238 | 20257 | AGCTATAATTAAATCTTTTT | 67 | 1718 |
| 1102178 | N/A | N/A | 20253 | 20272 | AATGTCTTTATTAATAGCTA | 47 | 1719 |
| 1102179 | N/A | N/A | 20254 | 20273 | AAATGTCTTTATTAATAGCT | 70 | 1720 |
| 1102180 | N/A | N/A | 20264 | 20283 | TCAGTAGTTTAAATGTCTTT | 18 | 1721 |
| 1102181 | N/A | N/A | 20289 | 20308 | CTCCCAAAAGAATAAAAATG | 97 | 1722 |
| 1102182 | N/A | N/A | 20294 | 20313 | AAACCCTCCCAAAAGAATAA | 92 | 1723 |
| 1102183 | N/A | N/A | 20299 | 20318 | ACATTAAACCCTCCCAAAAG | 83 | 1724 |
| 1102184 | N/A | N/A | 20300 | 20319 | AACATTAAACCCTCCCAAAA | 90 | 1725 |
| 1102185 | N/A | N/A | 20304 | 20323 | TATAAACATTAAACCCTCCC | 102 | 1726 |
| 1102186 | N/A | N/A | 20306 | 20325 | ACTATAAACATTAAACCCTC | 117 | 1727 |
| 1102187 | N/A | N/A | 20307 | 20326 | AACTATAAACATTAAACCCT | 86 | 1728 |
| 1102188 | N/A | N/A | 20311 | 20330 | TTTAAACTATAAACATTAAA | 87 | 1729 |
| 1102189 | N/A | N/A | 20314 | 20333 | TGCTTTAAACTATAAACATT | 72 | 1730 |
| 1102190 | N/A | N/A | 20315 | 20334 | TTGCTTTAAACTATAAACAT | 84 | 1731 |
| 1102191 | N/A | N/A | 20316 | 20335 | TTTGCTTTAAACTATAAACA | 91 | 1732 |
| 1102192 | N/A | N/A | 20318 | 20337 | AGTTTGCTTTAAACTATAAA | 75 | 1733 |
| 1102193 | N/A | N/A | 20976 | 20995 | TATCACTATTAAATACTTTT | 70 | 1734 |
| 1102195 | N/A | N/A | 20988 | 21007 | ATACTGCAGATTTATCACTA | 26 | 1735 |
| 1102197 | N/A | N/A | 21022 | 21041 | GACTGAATAATATGATCTTA | 27 | 1736 |
| 1102198 | N/A | N/A | 21051 | 21070 | GAAATATTTCAAGTTGAGCT | 15 | 1737 |
| 1102199 | N/A | N/A | 21053 | 21072 | TGGAAATATTTCAAGTTGAG | 27 | 1738 |
| 1102200 | N/A | N/A | 21054 | 21073 | CTGGAAATATTTCAAGTTGA | 15 | 1739 |
| 1102201 | N/A | N/A | 21055 | 21074 | TCTGGAAATATTTCAAGTTG | 43 | 1740 |
| 1102202 | N/A | N/A | 21069 | 21088 | AAGATTGTTTAAACTCTGGA | 16 | 1741 |
| 1102203 | N/A | N/A | 21093 | 21112 | AGATACAACCCATCAAAGCT | 89 | 1742 |
| 1102204 | N/A | N/A | 21094 | 21113 | TAGATACAACCCATCAAAGC | 145 | 1743 |
| 1102205 | N/A | N/A | 21101 | 21120 | TTAAGAATAGATACAACCCA | 99 | 1744 |
| 1102206 | N/A | N/A | 21106 | 21125 | ACATGTTAAGAATAGATACA | 86 | 1745 |
| 1102207 | N/A | N/A | 21116 | 21135 | AGGAAGTTTCACATGTTAAG | 71 | 1746 |
| 1102208 | N/A | N/A | 21152 | 21171 | TGTCAATATTTAAGTTAGTG | 93 | 1747 |
| 1102209 | N/A | N/A | 21153 | 21172 | TTGTCAATATTTAAGTTAGT | 77 | 1748 |
| 1102210 | N/A | N/A | 21154 | 21173 | ATTGTCAATATTTAAGTTAG | 84 | 1749 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102211 | N/A | N/A | 21178 | 21197 | TTCAAGTTAAACCACTGGAA | 77 | 1750 |
| 1102212 | N/A | N/A | 21180 | 21199 | AATTCAAGTTAAACCACTGG | 67 | 1751 |
| 1102213 | N/A | N/A | 21260 | 21279 | TTACTTACCTTCCTGTTGTA | 73 | 1752 |
| 1102214 | N/A | N/A | 21284 | 21303 | GTAACATTACAAAATGTTCA | 78 | 1753 |
| 1102215 | N/A | N/A | 21304 | 21323 | TTATTTAACTACTTCGAAAG | 84 | 1754 |
| 1102216 | N/A | N/A | 21311 | 21330 | TGCCTGGTTATTTAACTACT | 27 | 1755 |
| 1102217 | N/A | N/A | 21398 | 21417 | CAAATCACAGCCTATCACCA | 93 | 1756 |
| 1102218 | N/A | N/A | 21402 | 21421 | CACCCAAATCACAGCCTATC | 82 | 1757 |
| 1102219 | N/A | N/A | 21403 | 21422 | TCACCCAAATCACAGCCTAT | 62 | 1758 |
| 1102220 | N/A | N/A | 21404 | 21423 | GTCACCCAAATCACAGCCTA | 46 | 1759 |
| 1102221 | N/A | N/A | 21495 | 21514 | AGAAAAAGCCATTACTTAGA | 51 | 1760 |
| 1102222 | N/A | N/A | 21497 | 21516 | AAAGAAAAAGCCATTACTTA | 89 | 1761 |
| 1102223 | N/A | N/A | 21604 | 21623 | CATGTATTTCAAAGAAACTG | 62 | 1762 |
| 1102224 | N/A | N/A | 21955 | 21974 | CAAGGGATAGTTTAATCTAG | 70 | 1763 |
| 1102225 | N/A | N/A | 22004 | 22023 | GATCCTAAAATCACTGATGA | 85 | 1764 |
| 1102226 | N/A | N/A | 22005 | 22024 | AGATCCTAAAATCACTGATG | 64 | 1765 |
| 1102227 | N/A | N/A | 22007 | 22026 | TCAGATCCTAAAATCACTGA | 83 | 1766 |
| 1102228 | N/A | N/A | 22008 | 22027 | GTCAGATCCTAAAATCACTG | 47 | 1767 |
| 1102229 | N/A | N/A | 22009 | 22028 | AGTCAGATCCTAAAATCACT | 64 | 1768 |
| 1102231 | N/A | N/A | 22067 | 22086 | GACGATACAGAAATAATTAA | 73 | 1769 |
| 1102233 | N/A | N/A | 22204 | 22223 | AACATGGTTTAAAGATAGGA | 85 | 1770 |
| 1102234 | N/A | N/A | 22213 | 22232 | AACAGACAAAACATGGTTTA | 75 | 1771 |
| 1102235 | N/A | N/A | 22240 | 22259 | GGGTTTAAAGAATGGCTGGA | 64 | 1772 |
| 1102236 | N/A | N/A | 22244 | 22263 | AGTAGGGTTTAAAGAATGGC | 65 | 1773 |
| 1102237 | N/A | N/A | 22330 | 22349 | CAATGGAGTGATTATGATGA | 63 | 1774 |
| 1102238 | N/A | N/A | 22381 | 22400 | TTTGTCATTCAAGTATGATG | 41 | 1775 |
| 1102239 | N/A | N/A | 22403 | 22422 | TGGTTTAACCAGGGTTGAGA | 18 | 1776 |
| 1102240 | N/A | N/A | 22462 | 22481 | TATGTTATTTTTTAGCCACG | 61 | 1777 |
| 1102241 | N/A | N/A | 22464 | 22483 | TTTATGTTATTTTTTAGCCA | 89 | 1778 |
| 1102242 | N/A | N/A | 22480 | 22499 | AAACCAATCATCATGTTTTA | 55 | 1779 |
| 1102243 | N/A | N/A | 22481 | 22500 | AAAACCAATCATCATGTTTT | 56 | 1780 |
| 1102244 | N/A | N/A | 22482 | 22501 | TAAAACCAATCATCATGTTT | 47 | 1781 |
| 1102245 | N/A | N/A | 22486 | 22505 | AAAGTAAAACCAATCATCAT | 84 | 1782 |
| 1102246 | N/A | N/A | 22505 | 22524 | GGATAGATCATTTAAGAAAA | 38 | 1783 |
| 1102247 | N/A | N/A | 22589 | 22608 | ATGAGCTGTGATTATGCTGC | 82 | 1784 |
| 1102248 | N/A | N/A | 22691 | 22710 | AAAGTAAAACCTTAGCTAGG | 74 | 1785 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102249 | N/A | N/A | 22692 | 22711 | TAAAGTAAAACCTTAGCTAG | 105 | 1786 |
| 1102250 | N/A | N/A | 22695 | 22714 | ATTTAAAGTAAAACCTTAGC | 110 | 1787 |
| 1102251 | N/A | N/A | 22701 | 22720 | TAATAAATTTAAAGTAAAAC | 111 | 1788 |
| 1102252 | N/A | N/A | 22706 | 22725 | GATTATAATAAATTTAAAGT | 76 | 1789 |
| 1102253 | N/A | N/A | 22710 | 22729 | TTGTGATTATAATAAATTTA | 77 | 1790 |
| 1102254 | N/A | N/A | 22711 | 22730 | TTTGTGATTATAATAAATTT | 109 | 1791 |
| 1102255 | N/A | N/A | 22713 | 22732 | ATTTTGTGATTATAATAAAT | 97 | 1792 |
| 1102256 | N/A | N/A | 22715 | 22734 | GAATTTTGTGATTATAATAA | 112 | 1793 |
| 1102257 | N/A | N/A | 22748 | 22767 | GTAGAAATATCAGACAGCAC | 82 | 1794 |
| 1102258 | N/A | N/A | 22752 | 22771 | CATAGTAGAAATATCAGACA | 108 | 1795 |
| 1102259 | N/A | N/A | 22754 | 22773 | AACATAGTAGAAATATCAGA | 86 | 1796 |
| 1102260 | N/A | N/A | 22762 | 22781 | ACTAAGAAAACATAGTAGAA | 81 | 1797 |
| 1102261 | N/A | N/A | 22794 | 22813 | TTTTTATAAACACCTTGGA | 73 | 1798 |
| 1102262 | N/A | N/A | 22860 | 22879 | GTGAAATTAGTCACCTTGGA | 18 | 1799 |
| 1102263 | N/A | N/A | 22865 | 22884 | AAGCTGTGAAATTAGTCACC | 41 | 1800 |
| 1102264 | N/A | N/A | 22867 | 22886 | ATAAGCTGTGAAATTAGTCA | 58 | 1801 |
| 1102265 | N/A | N/A | 22883 | 22902 | TTAAAGGTTTAAAGACATAA | 109 | 1802 |
| 1102267 | N/A | N/A | 22965 | 22984 | AACATAATTTTAATTGCTTC | 62 | 1803 |
| 1102269 | N/A | N/A | 22967 | 22986 | AGAACATAATTTTAATTGCT | 75 | 1804 |
| 1102270 | N/A | N/A | 22997 | 23016 | ATAAGCAAATTGATAAATTT | 91 | 1805 |
| 1102271 | N/A | N/A | 23008 | 23027 | CAGGTGAAGATATAAGCAAA | 66 | 1806 |
| 1102272 | N/A | N/A | 23010 | 23029 | CACAGGTGAAGATATAAGCA | 78 | 1807 |
| 1102273 | N/A | N/A | 23012 | 23031 | AGCACAGGTGAAGATATAAG | 68 | 1808 |
| 1102274 | N/A | N/A | 23037 | 23056 | CATTCATCTATTTAAATAGG | 64 | 1809 |
| 1102275 | N/A | N/A | 23150 | 23169 | GAACTGATTATATAAGAGAG | 74 | 1810 |
| 1102276 | N/A | N/A | 23175 | 23194 | GGAATATTACAAAAAAAGGG | 102 | 1811 |
| 1102277 | N/A | N/A | 23289 | 23308 | AGAGACAATCCTAAGGAAAA | 93 | 1812 |
| 1102278 | N/A | N/A | 23290 | 23309 | TAGAGACAATCCTAAGGAAA | 52 | 1813 |
| 1102279 | N/A | N/A | 23293 | 23312 | CACTAGAGACAATCCTAAGG | 69 | 1814 |
| 1102280 | N/A | N/A | 23603 | 23622 | ATGGAGAAACCCCTTCCATC | 74 | 1815 |
| 1102281 | N/A | N/A | 23874 | 23893 | ATACCATTACTAAAAGATGG | 79 | 1816 |
| 1102282 | N/A | N/A | 23879 | 23898 | TCCAAATACCATTACTAAAA | 49 | 1817 |
| 1102283 | N/A | N/A | 23880 | 23899 | CTCCAAATACCATTACTAAA | 41 | 1818 |
| 1102284 | N/A | N/A | 23883 | 23902 | GATCTCCAAATACCATTACT | 42 | 1819 |
| 1102285 | N/A | N/A | 23900 | 23919 | GCCAGCACTCAAATTGTGAT | 53 | 1820 |
| 1102286 | N/A | N/A | 23927 | 23946 | CATAACAAACCCAGCAGCAA | 91 | 1821 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102287 | N/A | N/A | 23933 | 23952 | TAACTACATAACAAACCCAG | 85 | 1822 |
| 1102288 | N/A | N/A | 23936 | 23955 | CAATAACTACATAACAAACC | 81 | 1823 |
| 1102289 | N/A | N/A | 23937 | 23956 | ACAATAACTACATAACAAAC | 96 | 1824 |
| 1102290 | N/A | N/A | 23939 | 23958 | TCACAATAACTACATAACAA | 74 | 1825 |
| 1102291 | N/A | N/A | 23940 | 23959 | TTCACAATAACTACATAACA | 78 | 1826 |
| 1102292 | N/A | N/A | 23941 | 23960 | ATTCACAATAACTACATAAC | 85 | 1827 |
| 1102293 | N/A | N/A | 23945 | 23964 | GTGAATTCACAATAACTACA | 61 | 1828 |
| 1102294 | N/A | N/A | 23946 | 23965 | TGTGAATTCACAATAACTAC | 88 | 1829 |
| 1102295 | N/A | N/A | 23947 | 23966 | ATGTGAATTCACAATAACTA | 89 | 1830 |
| 1102296 | N/A | N/A | 23959 | 23978 | CTATATTCCTAAATGTGAAT | 85 | 1831 |
| 1102297 | N/A | N/A | 23964 | 23983 | AAACCCTATATTCCTAAATG | 107 | 1832 |
| 1102298 | N/A | N/A | 23970 | 23989 | AATTAAAAACCCTATATTCC | 91 | 1833 |
| 1102299 | N/A | N/A | 23971 | 23990 | GAATTAAAAACCCTATATTC | 93 | 1834 |
| 1102300 | N/A | N/A | 23984 | 24003 | ATCTAAAATCAAAGAATTAA | 93 | 1835 |
| 1102301 | N/A | N/A | 23985 | 24004 | TATCTAAAATCAAAGAATTA | 127 | 1836 |
| 1102303 | N/A | N/A | 23987 | 24006 | AGTATCTAAAATCAAAGAAT | 93 | 1837 |
| 1102305 | N/A | N/A | 23990 | 24009 | ACAAGTATCTAAAATCAAAG | 83 | 1838 |
| 1102306 | N/A | N/A | 23991 | 24010 | TACAAGTATCTAAAATCAAA | 124 | 1839 |
| 1102307 | N/A | N/A | 23998 | 24017 | AAAAAGATACAAGTATCTAA | 113 | 1840 |
| 1102308 | N/A | N/A | 24001 | 24020 | AGAAAAAAGATACAAGTATC | 82 | 1841 |
| 1102309 | N/A | N/A | 24017 | 24036 | AGGTTTTAAATATAAAAGAA | 94 | 1842 |
| 1102310 | N/A | N/A | 24020 | 24039 | CCAAGGTTTTAAATATAAAA | 75 | 1843 |
| 1102311 | N/A | N/A | 24070 | 24089 | GCTGAAGGCCAAAGGTAGAC | 72 | 1844 |
| 1102312 | N/A | N/A | 24092 | 24111 | TAGGAAAACCACAGCATGGT | 85 | 1845 |
| 1102313 | N/A | N/A | 24093 | 24112 | TTAGGAAAACCACAGCATGG | 80 | 1846 |
| 1102314 | N/A | N/A | 24094 | 24113 | GTTAGGAAAACCACAGCATG | 94 | 1847 |
| 1102315 | N/A | N/A | 24145 | 24164 | ACAGATGATATTTAAGATCC | 66 | 1848 |
| 1102316 | N/A | N/A | 24158 | 24177 | ATAGATCTTATTTACAGATG | 103 | 1849 |
| 1102317 | N/A | N/A | 24194 | 24213 | CAAGACTAAAGATAAAAGTT | 85 | 1850 |
| 1102318 | N/A | N/A | 24197 | 24216 | TGTCAAGACTAAAGATAAAA | 82 | 1851 |
| 1102319 | N/A | N/A | 24199 | 24218 | GATGTCAAGACTAAAGATAA | 76 | 1852 |
| 1102320 | N/A | N/A | 24229 | 24248 | GGAGTTAGTCAAAGCTAGGT | 47 | 1853 |
| 1102321 | N/A | N/A | 24231 | 24250 | TAGGAGTTAGTCAAAGCTAG | 62 | 1854 |
| 1102322 | N/A | N/A | 24246 | 24265 | TGGAGATGCCAAAGCTAGGA | 28 | 1855 |
| 1102323 | N/A | N/A | 24292 | 24311 | TCTTTCATAGACATGTTCAG | 64 | 1856 |
| 1102324 | N/A | N/A | 24297 | 24316 | ATAAGTCTTTCATAGACATG | 98 | 1857 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102325 | N/A | N/A | 24337 | 24356 | AATGGAAAACCTGATGGATA | 84 | 1858 |
| 1102326 | N/A | N/A | 24355 | 24374 | AAGAGTCACCCTTATGGAAA | 68 | 1859 |
| 1102327 | N/A | N/A | 24382 | 24401 | CGGTATAATATATAGGAACC | 48 | 1860 |
| 1102328 | N/A | N/A | 24384 | 24403 | GTCGGTATAATATATAGGAA | 23 | 1861 |
| 1102329 | N/A | N/A | 24819 | 24838 | GGTTTTATTCAAGACTTCAC | 9 | 1862 |
| 1102330 | N/A | N/A | 24823 | 24842 | CTTGGGTTTTATTCAAGACT | 54 | 1863 |
| 1102331 | N/A | N/A | 24892 | 24911 | ACCATGGTATTCTATGAAGA | 70 | 1864 |
| 1102332 | N/A | N/A | 24909 | 24928 | AATAAATATGCCAGCTCACC | 39 | 1865 |
| 1102333 | N/A | N/A | 24914 | 24933 | TGTATAATAAATATGCCAGC | 23 | 1866 |
| 1102334 | N/A | N/A | 24915 | 24934 | TTGTATAATAAATATGCCAG | 31 | 1867 |
| 1102335 | N/A | N/A | 24936 | 24955 | GCCAGTAAAATTGTTTCTGT | 41 | 1868 |
| 1102336 | N/A | N/A | 24994 | 25013 | TGAACATTTTTTATGAGGAC | 8 | 1869 |
| 1102337 | N/A | N/A | 24995 | 25014 | TTGAACATTTTTTATGAGGA | 26 | 1870 |
| 1102339 | N/A | N/A | 25019 | 25038 | AATGGAAAACCTCAAAATAG | 75 | 1871 |
| 1102341 | N/A | N/A | 25438 | 25457 | ATCTAACTGATTTAAGTTTC | 112 | 1872 |
| 1102342 | N/A | N/A | 25449 | 25468 | TACCTAAAACAATCTAACTG | 103 | 1873 |
| 1102343 | N/A | N/A | 25453 | 25472 | GCTATACCTAAAACAATCTA | 68 | 1874 |
| 1102344 | N/A | N/A | 25454 | 25473 | GGCTATACCTAAAACAATCT | 55 | 1875 |
| 1102345 | N/A | N/A | 25455 | 25474 | GGGCTATACCTAAAACAATC | 55 | 1876 |
| 1102346 | N/A | N/A | 25457 | 25476 | ATGGGCTATACCTAAAACAA | 101 | 1877 |
| 1102347 | N/A | N/A | 25473 | 25492 | CACACAAAAACCAAGGATGG | 59 | 1878 |
| 1102348 | N/A | N/A | 25499 | 25518 | CCAGGGTTTCCCCAAGCTAG | 54 | 1879 |
| 1102349 | N/A | N/A | 25507 | 25526 | CCAGAAATCCAGGGTTTCCC | 73 | 1880 |
| 1102350 | N/A | N/A | 25509 | 25528 | TTCCAGAAATCCAGGGTTTC | 56 | 1881 |
| 1102351 | N/A | N/A | 25513 | 25532 | ATGATTCCAGAAATCCAGGG | 18 | 1882 |
| 1102352 | N/A | N/A | 25515 | 25534 | ATATGATTCCAGAAATCCAG | 41 | 1883 |
| 1102353 | N/A | N/A | 25521 | 25540 | GTCTAAATATGATTCCAGAA | 6 | 1884 |
| 1102354 | N/A | N/A | 25545 | 25564 | ATTACATTAGTCTAGTGTGA | 51 | 1885 |
| 1102355 | N/A | N/A | 25550 | 25569 | AAAGAATTACATTAGTCTAG | 64 | 1886 |
| 1102356 | N/A | N/A | 25551 | 25570 | AAAAGAATTACATTAGTCTA | 87 | 1887 |
| 1102357 | N/A | N/A | 25554 | 25573 | CCCAAAAGAATTACATTAGT | 60 | 1888 |
| 1102358 | N/A | N/A | 25555 | 25574 | TCCCAAAAGAATTACATTAG | 67 | 1889 |
| 1102359 | N/A | N/A | 25556 | 25575 | ATCCCAAAAGAATTACATTA | 95 | 1890 |
| 1102360 | N/A | N/A | 25561 | 25580 | TTTGCATCCCAAAAGAATTA | 75 | 1891 |
| 1102361 | N/A | N/A | 25590 | 25609 | AAAAGCTATTTAAGGTGTCA | 26 | 1892 |
| 1102362 | N/A | N/A | 25591 | 25610 | TAAAAGCTATTTAAGGTGTC | 56 | 1893 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102363 | N/A | N/A | 25592 | 25611 | CTAAAAGCTATTTAAGGTGT | 67 | 1894 |
| 1102364 | N/A | N/A | 25600 | 25619 | CCAAATACCTAAAAGCTATT | 84 | 1895 |
| 1102365 | N/A | N/A | 25601 | 25620 | GCCAAATACCTAAAAGCTAT | 108 | 1896 |
| 1102366 | N/A | N/A | 25602 | 25621 | AGCCAAATACCTAAAAGCTA | 86 | 1897 |
| 1102367 | N/A | N/A | 25603 | 25622 | AAGCCAAATACCTAAAAGCT | 71 | 1898 |
| 1102368 | N/A | N/A | 25604 | 25623 | GAAGCCAAATACCTAAAAGC | 54 | 1899 |
| 1102369 | N/A | N/A | 25605 | 25624 | GGAAGCCAAATACCTAAAAG | 44 | 1900 |
| 1102370 | N/A | N/A | 25632 | 25651 | ACCCCTTGTAACTAAAAATA | 93 | 1901 |
| 1102371 | N/A | N/A | 25689 | 25708 | TGGCTAAAACTAATCATCTG | 71 | 1902 |
| 1102372 | N/A | N/A | 25690 | 25709 | ATGGCTAAAACTAATCATCT | 70 | 1903 |
| 1102373 | N/A | N/A | 25691 | 25710 | CATGGCTAAAACTAATCATC | 98 | 1904 |
| 1102375 | N/A | N/A | 25805 | 25824 | CATTACCCTTCATATATACA | 73 | 1905 |
| 1102377 | N/A | N/A | 25814 | 25833 | TCCTTAATACATTACCCTTC | 62 | 1906 |
| 1102378 | N/A | N/A | 25822 | 25841 | GTCGATACTCCTTAATACAT | 23 | 1907 |
| 1102379 | N/A | N/A | 26243 | 26262 | CTACAAATTATTGTTTCTGG | 17 | 1908 |
| 1102380 | N/A | N/A | 26245 | 26264 | GGCTACAAATTATTGTTTCT | 25 | 1909 |
| 1102381 | N/A | N/A | 26246 | 26265 | AGGCTACAAATTATTGTTTC | 58 | 1910 |
| 1102382 | N/A | N/A | 26247 | 26266 | AAGGCTACAAATTATTGTTT | 50 | 1911 |
| 1102383 | N/A | N/A | 26249 | 26268 | TGAAGGCTACAAATTATTGT | 40 | 1912 |
| 1102384 | N/A | N/A | 26311 | 26330 | ACTGTTAAACATATGATACT | 73 | 1913 |
| 1102385 | N/A | N/A | 26322 | 26341 | TCTTGGTTTCTACTGTTAAA | 78 | 1914 |
| 1102386 | N/A | N/A | 26455 | 26474 | AAAGGGCCCTACTAATATAG | 107 | 1915 |
| 1102387 | N/A | N/A | 26475 | 26494 | TGAGAAATAAATATGTCTGT | 79 | 1916 |
| 1102388 | N/A | N/A | 26525 | 26544 | CCTCACTTTCTCCATTGTAA | 47 | 1917 |
| 1102389 | N/A | N/A | 26577 | 26596 | TCTTATACTTACTAGTAAAG | 77 | 1918 |
| 1102390 | N/A | N/A | 26580 | 26599 | GATTCTTATACTTACTAGTA | 70 | 1919 |
| 1102391 | N/A | N/A | 26581 | 26600 | TGATTCTTATACTTACTAGT | 92 | 1920 |
| 1102392 | N/A | N/A | 26584 | 26603 | TAATGATTCTTATACTTACT | 59 | 1921 |
| 1102393 | N/A | N/A | 26585 | 26604 | ATAATGATTCTTATACTTAC | 87 | 1922 |
| 1102394 | N/A | N/A | 26593 | 26612 | TAGTCCAAATAATGATTCTT | 50 | 1923 |
| 1102395 | N/A | N/A | 26629 | 26648 | TGGAAAAAAATACAAGCTGA | 88 | 1924 |
| 1102396 | N/A | N/A | 26630 | 26649 | CTGGAAAAAAATACAAGCTG | 68 | 1925 |
| 1102397 | N/A | N/A | 26631 | 26650 | ACTGGAAAAAAATACAAGCT | 84 | 1926 |
| 1102398 | N/A | N/A | 26632 | 26651 | CACTGGAAAAAAATACAAGC | 99 | 1927 |
| 1102399 | N/A | N/A | 26680 | 26699 | GATTCAAAATTGATGTAAAA | 95 | 1928 |
| 1102400 | N/A | N/A | 26681 | 26700 | AGATTCAAAATTGATGTAAA | 91 | 1929 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102401 | N/A | N/A | 26684 | 26703 | AAGAGATTCAAAATTGATGT | 124 | 1930 |
| 1102402 | N/A | N/A | 26685 | 26704 | AAAGAGATTCAAAATTGATG | 86 | 1931 |
| 1102403 | N/A | N/A | 26707 | 26726 | AAAATCAACCTAACCAGTTA | 87 | 1932 |
| 1102404 | N/A | N/A | 26708 | 26727 | AAAAATCAACCTAACCAGTT | 109 | 1933 |
| 1102405 | N/A | N/A | 26714 | 26733 | AAAGGCAAAAATCAACCTAA | 102 | 1934 |
| 1102406 | N/A | N/A | 26733 | 26752 | ATAGAATAACCTAAAAAAAA | 78 | 1935 |
| 1102407 | N/A | N/A | 26734 | 26753 | TATAGAATAACCTAAAAAAA | 131 | 1936 |
| 1102408 | N/A | N/A | 26737 | 26756 | AAATATAGAATAACCTAAAA | 102 | 1937 |
| 1102409 | N/A | N/A | 26739 | 26758 | ACAAATATAGAATAACCTAA | 95 | 1938 |
| 1102411 | N/A | N/A | 26870 | 26889 | GGCCTCATTTTTACCTTTGC | 85 | 1939 |
| 1102413 | N/A | N/A | 26898 | 26917 | GAAATACTACCATATATTCC | 89 | 1940 |
| 1102414 | N/A | N/A | 26923 | 26942 | AGCATGAAAATTTAATTCTC | 91 | 1941 |
| 1102415 | N/A | N/A | 26986 | 27005 | TTCACTAAAATATAAGGTCC | 73 | 1942 |
| 1102416 | N/A | N/A | 26995 | 27014 | CTAATAAACTTCACTAAAAT | 111 | 1943 |
| 1102417 | N/A | N/A | 26996 | 27015 | ACTAATAAACTTCACTAAAA | 70 | 1944 |
| 1102418 | N/A | N/A | 27008 | 27027 | ATTCAAGTTTAAACTAATAA | 85 | 1945 |
| 1102419 | N/A | N/A | 27027 | 27046 | TAAGTATTTCAAAGAGTTGA | 37 | 1946 |
| 1102420 | N/A | N/A | 27029 | 27048 | TTTAAGTATTTCAAAGAGTT | 110 | 1947 |
| 1102421 | N/A | N/A | 27036 | 27055 | TAATATATTTAAGTATTTCA | 82 | 1948 |
| 1102422 | N/A | N/A | 27043 | 27062 | ACTAAGTTAATATATTTAAG | 119 | 1949 |
| 1102423 | N/A | N/A | 27064 | 27083 | AGGAATATACCATACCAGCT | 34 | 1950 |
| 1102424 | N/A | N/A | 27066 | 27085 | CTAGGAATATACCATACCAG | 19 | 1951 |
| 1102425 | N/A | N/A | 27391 | 27410 | CTAGTAATATAATGATTGTG | 37 | 1952 |
| 1102426 | N/A | N/A | 27394 | 27413 | GCTCTAGTAATATAATGATT | 35 | 1953 |
| 1102427 | N/A | N/A | 27407 | 27426 | TTCTGGCAAATAAGCTCTAG | 44 | 1954 |
| 1102428 | N/A | N/A | 27470 | 27489 | TTAGACATAACATAAAGGCA | 68 | 1955 |
| 1102429 | N/A | N/A | 27481 | 27500 | AATCTTCTATTTTAGACATA | 93 | 1956 |
| 1102430 | N/A | N/A | 27486 | 27505 | CAACCAATCTTCTATTTTAG | 84 | 1957 |
| 1102431 | N/A | N/A | 27487 | 27506 | GCAACCAATCTTCTATTTTA | 83 | 1958 |
| 1102432 | N/A | N/A | 27492 | 27511 | TAACTGCAACCAATCTTCTA | 114 | 1959 |
| 1102433 | N/A | N/A | 27518 | 27537 | ACTCTAAAGAACAAAAGCAC | 85 | 1960 |
| 1102434 | N/A | N/A | 27523 | 27542 | TATGGACTCTAAAGAACAAA | 75 | 1961 |
| 1102435 | N/A | N/A | 27690 | 27709 | GTCTTTACCTTGCATACTTA | 65 | 1962 |
| 1102436 | N/A | N/A | 27697 | 27716 | TCAGAATGTCTTTACCTTGC | 104 | 1963 |
| 1102437 | N/A | N/A | 27712 | 27731 | TGAATACAACACACATCAGA | 81 | 1964 |
| 1102438 | N/A | N/A | 27718 | 27737 | CAGCAATGAATACAACACAC | 84 | 1965 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102439 | N/A | N/A | 27720 | 27739 | TTCAGCAATGAATACAACAC | 75 | 1966 |
| 1102440 | N/A | N/A | 27729 | 27748 | AATCAATTCTTCAGCAATGA | 100 | 1967 |
| 1102441 | N/A | N/A | 27730 | 27749 | GAATCAATTCTTCAGCAATG | 70 | 1968 |
| 1102442 | N/A | N/A | 27748 | 27767 | GAAATCTAAGAATAATTGGA | 108 | 1969 |
| 1102443 | N/A | N/A | 27763 | 27782 | TACATTAACTTCCATGAAAT | 91 | 1970 |
| 1102444 | N/A | N/A | 27770 | 27789 | CTAAGAGTACATTAACTTCC | 68 | 1971 |
| 1102445 | N/A | N/A | 27786 | 27805 | AATTGTCAAAACACCTCTAA | 77 | 1972 |
| 1102447 | N/A | N/A | 27824 | 27843 | AAAGGGAAAGCCCACTATAT | 118 | 1973 |
| 1102449 | N/A | N/A | 27848 | 27867 | AGTGATTTCCATTATAAGAA | 71 | 1974 |
| 1102450 | N/A | N/A | 27849 | 27868 | AAGTGATTTCCATTATAAGA | 69 | 1975 |
| 1102451 | N/A | N/A | 27872 | 27891 | CCTAATAAAATATAGGTTGT | 82 | 1976 |
| 1102452 | N/A | N/A | 27873 | 27892 | TCCTAATAAAATATAGGTTG | 108 | 1977 |
| 1102453 | N/A | N/A | 27874 | 27893 | CTCCTAATAAAATATAGGTT | 86 | 1978 |
| 1102454 | N/A | N/A | 27875 | 27894 | ACTCCTAATAAAATATAGGT | 166 | 1979 |
| 1102455 | N/A | N/A | 27882 | 27901 | TATAACTACTCCTAATAAAA | 82 | 1980 |
| 1102456 | N/A | N/A | 27885 | 27904 | AAATATAACTACTCCTAATA | 109 | 1981 |
| 1102457 | N/A | N/A | 27887 | 27906 | AAAAATATAACTACTCCTAA | 120 | 1982 |
| 1102458 | N/A | N/A | 27893 | 27912 | AGGAGTAAAAATATAACTAC | 117 | 1983 |
| 1102459 | N/A | N/A | 27894 | 27913 | CAGGAGTAAAAATATAACTA | 109 | 1984 |
| 1102460 | N/A | N/A | 27895 | 27914 | CCAGGAGTAAAAATATAACT | 91 | 1985 |
| 1102461 | N/A | N/A | 27903 | 27922 | TAAAATAACCAGGAGTAAAA | 88 | 1986 |
| 1102462 | N/A | N/A | 27908 | 27927 | CCAAATAAAATAACCAGGAG | 86 | 1987 |
| 1102463 | N/A | N/A | 27910 | 27929 | AACCAAATAAAATAACCAGG | 89 | 1988 |
| 1102464 | N/A | N/A | 27916 | 27935 | TGTTGAAACCAAATAAAATA | 108 | 1989 |
| 1102465 | N/A | N/A | 27943 | 27962 | CCACAATTTACTATTGTGTT | 96 | 1990 |
| 1102466 | N/A | N/A | 27947 | 27966 | AAAACCACAATTTACTATTG | 94 | 1991 |
| 1102467 | N/A | N/A | 27953 | 27972 | AAGATTAAAACCACAATTTA | 89 | 1992 |
| 1102468 | N/A | N/A | 27966 | 27985 | ACTGATACCCACAAAGATTA | 77 | 1993 |
| 1102469 | N/A | N/A | 27974 | 27993 | AAGGGTCAACTGATACCCAC | 89 | 1994 |
| 1102470 | N/A | N/A | 28007 | 28026 | ATGGCACATATTTATGTAAC | 51 | 1995 |
| 1102471 | N/A | N/A | 28083 | 28102 | AGTTGCATAGCCAATAAATG | 54 | 1996 |
| 1102472 | N/A | N/A | 28126 | 28145 | TATCACTAAAAAACTGGGCC | 100 | 1997 |
| 1102473 | N/A | N/A | 28127 | 28146 | ATATCACTAAAAAACTGGGC | 79 | 1998 |
| 1102474 | N/A | N/A | 28128 | 28147 | TATATCACTAAAAAACTGGG | 94 | 1999 |
| 1102475 | N/A | N/A | 28129 | 28148 | TTATATCACTAAAAAACTGG | 102 | 2000 |
| 1102476 | N/A | N/A | 28131 | 28150 | GTTTATATCACTAAAAAACT | 90 | 2001 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102477 | N/A | N/A | 28132 | 28151 | AGTTTATATCACTAAAAAAC | 146 | 2002 |
| 1102478 | N/A | N/A | 28133 | 28152 | TAGTTTATATCACTAAAAAA | 87 | 2003 |
| 1102479 | N/A | N/A | 28134 | 28153 | ATAGTTTATATCACTAAAAA | 101 | 2004 |
| 1102480 | N/A | N/A | 28136 | 28155 | TGATAGTTTATATCACTAAA | 99 | 2005 |
| 1102481 | N/A | N/A | 28138 | 28157 | ATTGATAGTTTATATCACTA | 94 | 2006 |
| 1102483 | N/A | N/A | 28195 | 28214 | TGTCTTAACATTTTTCTTTG | 47 | 2007 |
| 1102485 | N/A | N/A | 28229 | 28248 | CACTTCAAACTTTTAATTAA | 94 | 2008 |
| 1102486 | N/A | N/A | 28230 | 28249 | CCACTTCAAACTTTTAATTA | 80 | 2009 |
| 1102487 | N/A | N/A | 28233 | 28252 | AACCCACTTCAAACTTTTAA | 75 | 2010 |
| 1102488 | N/A | N/A | 28235 | 28254 | AAAACCCACTTCAAACTTTT | 83 | 2011 |
| 1102489 | N/A | N/A | 28271 | 28290 | AAGCAAATACATATGAGTTA | 59 | 2012 |
| 1102490 | N/A | N/A | 28273 | 28292 | AGAAGCAAATACATATGAGT | 24 | 2013 |
| 1102491 | N/A | N/A | 28274 | 28293 | TAGAAGCAAATACATATGAG | 83 | 2014 |
| 1102492 | N/A | N/A | 28288 | 28307 | ATTTCATTAGAAAGTAGAAG | 98 | 2015 |
| 1102493 | N/A | N/A | 28293 | 28312 | AAATAATTTCATTAGAAAGT | 97 | 2016 |
| 1102494 | N/A | N/A | 28297 | 28316 | TGATAAATAATTTCATTAGA | 95 | 2017 |
| 1102495 | N/A | N/A | 28340 | 28359 | TTAATGAAATTTCAATTTTA | 110 | 2018 |
| 1102496 | N/A | N/A | 28351 | 28370 | TAATCTTCCCATTAATGAAA | 85 | 2019 |
| 1102497 | N/A | N/A | 28355 | 28374 | AAAATAATCTTCCCATTAAT | 83 | 2020 |
| 1102498 | N/A | N/A | 28360 | 28379 | GGATAAAAATAATCTTCCCA | 79 | 2021 |
| 1102499 | N/A | N/A | 28361 | 28380 | AGGATAAAAATAATCTTCCC | 62 | 2022 |
| 1102500 | N/A | N/A | 28378 | 28397 | AGAGGCAAGAAAAGTTCAGG | 54 | 2023 |
| 1102501 | N/A | N/A | 28414 | 28433 | GATTGCACACCATATGGAGT | 63 | 2024 |
| 1102502 | N/A | N/A | 28431 | 28450 | CTATTAATCAAAAATGGGAT | 119 | 2025 |
| 1102503 | N/A | N/A | 28432 | 28451 | TCTATTAATCAAAAATGGGA | 79 | 2026 |
| 1102504 | N/A | N/A | 28434 | 28453 | ACTCTATTAATCAAAAATGG | 80 | 2027 |
| 1102505 | N/A | N/A | 28437 | 28456 | AGGACTCTATTAATCAAAAA | 77 | 2028 |
| 1102506 | N/A | N/A | 28439 | 28458 | GCAGGACTCTATTAATCAAA | 105 | 2029 |
| 1102507 | N/A | N/A | 28452 | 28471 | CCCTGCTAATCCAGCAGGAC | 130 | 2030 |
| 1102508 | N/A | N/A | 28477 | 28496 | AAAGAAATCTAAAGCTGATT | 115 | 2031 |
| 1102509 | N/A | N/A | 28810 | 28829 | AGAATATTCTACTCTTCTGG | 111 | 2032 |
| 1102510 | N/A | N/A | 28813 | 28832 | TTAAGAATATTCTACTCTTC | 103 | 2033 |
| 1102511 | N/A | N/A | 28817 | 28836 | CTCTTTAAGAATATTCTACT | 65 | 2034 |
| 1102512 | N/A | N/A | 28818 | 28837 | TCTCTTTAAGAATATTCTAC | 80 | 2035 |
| 1102513 | N/A | N/A | 28872 | 28891 | TTCAAGCAACAATATGTTTG | 86 | 2036 |
| 1102514 | N/A | N/A | 28880 | 28899 | TTTACCAATTCAAGCAACAA | 109 | 2037 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102515 | N/A | N/A | 28881 | 28900 | ATTTACCAATTCAAGCAACA | 128 | 2038 |
| 1102516 | N/A | N/A | 28883 | 28902 | GTATTTACCAATTCAAGCAA | 67 | 2039 |
| 1102517 | N/A | N/A | 28886 | 28905 | ACTGTATTTACCAATTCAAG | 86 | 2040 |
| 1102519 | N/A | N/A | 28895 | 28914 | AAACCAATCACTGTATTTAC | 126 | 2041 |
| 1102521 | N/A | N/A | 28902 | 28921 | ACAACAAAAACCAATCACTG | 100 | 2042 |
| 1102522 | N/A | N/A | 28903 | 28922 | CACAACAAAAACCAATCACT | 78 | 2043 |
| 1102523 | N/A | N/A | 28922 | 28941 | ACCTGAAAACAAAACACAAC | 95 | 2044 |
| 1102524 | N/A | N/A | 28923 | 28942 | TACCTGAAAACAAAACACAA | 25 | 2045 |
| 1102525 | N/A | N/A | 28926 | 28945 | AACTACCTGAAAACAAAACA | 78 | 2046 |
| 1102526 | N/A | N/A | 29022 | 29041 | TTTACTTTTCAAAGTAGGCT | 82 | 2047 |
| 1102527 | N/A | N/A | 29023 | 29042 | CTTTACTTTTCAAAGTAGGC | 109 | 2048 |
| 1102528 | N/A | N/A | 29025 | 29044 | TACTTTACTTTTCAAAGTAG | 109 | 2049 |
| 1102529 | N/A | N/A | 29028 | 29047 | AACTACTTTACTTTTCAAAG | 99 | 2050 |
| 1102530 | N/A | N/A | 29032 | 29051 | TACCAACTACTTTACTTTTC | 85 | 2051 |
| 1102531 | N/A | N/A | 29035 | 29054 | TTGTACCAACTACTTTACTT | 88 | 2052 |
| 1102532 | N/A | N/A | 29051 | 29070 | AACATGCTACTTTAACTTGT | 78 | 2053 |
| 1102533 | N/A | N/A | 29062 | 29081 | AGCAAATATTAAACATGCTA | 109 | 2054 |
| 1102534 | N/A | N/A | 29074 | 29093 | CAAAATAGCCAAAGCAAATA | 82 | 2055 |
| 1102535 | N/A | N/A | 29076 | 29095 | GACAAAATAGCCAAAGCAAA | 62 | 2056 |
| 1102536 | N/A | N/A | 29085 | 29104 | TTACAAATAGACAAAATAGC | 76 | 2057 |
| 1102537 | N/A | N/A | 29091 | 29110 | AACCATTTACAAATAGACAA | 63 | 2058 |
| 1102538 | N/A | N/A | 29096 | 29115 | GCAGTAACCATTTACAAATA | 42 | 2059 |
| 1102539 | N/A | N/A | 29119 | 29138 | ATTCAAATATTCACAGGATT | 55 | 2060 |
| 1102540 | N/A | N/A | 29125 | 29144 | AAATACATTCAAATATTCAC | 89 | 2061 |
| 1102541 | N/A | N/A | 29476 | 29495 | GCCGTAAATTTTTATTTTTA | 16 | 2062 |
| 1102542 | N/A | N/A | 29477 | 29496 | TGCCGTAAATTTTTATTTTT | 40 | 2063 |
| 1102543 | N/A | N/A | 29529 | 29548 | GTTTAAAAAATTTATCCAGT | 82 | 2064 |
| 1102544 | N/A | N/A | 29530 | 29549 | AGTTTAAAAAATTTATCCAG | 88 | 2065 |
| 1102545 | N/A | N/A | 29531 | 29550 | CAGTTTAAAAAATTTATCCA | 109 | 2066 |
| 1102546 | N/A | N/A | 29535 | 29554 | CACTCAGTTTAAAAAATTTA | 78 | 2067 |
| 1102547 | N/A | N/A | 29548 | 29567 | ATAAGGTTTCCTTCACTCAG | 22 | 2068 |
| 1102548 | N/A | N/A | 29561 | 29580 | TAAATGAAATTTTATAAGGT | 109 | 2069 |
| 1102549 | N/A | N/A | 29585 | 29604 | GTCCTAATTTCATTTTTCTT | 30 | 2070 |
| 1102550 | N/A | N/A | 29587 | 29606 | TTGTCCTAATTTCATTTTTC | 58 | 2071 |
| 1102551 | N/A | N/A | 29645 | 29664 | AGGGTTAATCAGGTAAGCAA | 8 | 2072 |
| 1102552 | N/A | N/A | 29647 | 29666 | GCAGGGTTAATCAGGTAAGC | 17 | 2073 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102553 | N/A | N/A | 29807 | 29826 | TTGATCCAGATTTATGGTTT | 28 | 2074 |
| 1102555 | N/A | N/A | 29812 | 29831 | AGGAGTTGATCCAGATTTAT | 28 | 2075 |
| 1102557 | N/A | N/A | 29881 | 29900 | AATGTATTTTCATATGGTGG | 10 | 2076 |
| 1102558 | N/A | N/A | 29901 | 29920 | AATGATAGTTACTTGAAAAG | 87 | 2077 |
| 1102559 | N/A | N/A | 30269 | 30288 | TCTTGTAATCTTTAACATGA | 84 | 2078 |
| 1102560 | N/A | N/A | 30280 | 30299 | CTGATTATTTATCTTGTAAT | 34 | 2079 |
| 1102561 | N/A | N/A | 30281 | 30300 | TCTGATTATTTATCTTGTAA | 34 | 2080 |
| 1102562 | N/A | N/A | 30282 | 30301 | GTCTGATTATTTATCTTGTA | 14 | 2081 |
| 1102563 | N/A | N/A | 30283 | 30302 | GGTCTGATTATTTATCTTGT | 15 | 2082 |
| 1102564 | N/A | N/A | 30350 | 30369 | TGGATGAAATACAGCAAATA | 42 | 2083 |
| 1102565 | N/A | N/A | 30354 | 30373 | AGAATGGATGAAATACAGCA | 82 | 2084 |
| 1102566 | N/A | N/A | 30376 | 30395 | AATGTGAAACTATGTGCATC | 57 | 2085 |
| 1102567 | N/A | N/A | 30378 | 30397 | GAAATGTGAAACTATGTGCA | 29 | 2086 |
| 1102568 | N/A | N/A | 30380 | 30399 | TTGAAATGTGAAACTATGTG | 58 | 2087 |
| 1102569 | N/A | N/A | 30398 | 30417 | TTCTCAATTTCAGAGACATT | 46 | 2088 |
| 1102570 | N/A | N/A | 30399 | 30418 | CTTCTCAATTTCAGAGACAT | 38 | 2089 |
| 1102571 | N/A | N/A | 30400 | 30419 | GCTTCTCAATTTCAGAGACA | 37 | 2090 |
| 1102572 | N/A | N/A | 30436 | 30455 | GTGCTGCTAATATACTGTCA | 26 | 2091 |
| 1102573 | N/A | N/A | 30452 | 30471 | GAGCCAATATTTATAGGTGC | 21 | 2092 |
| 1102574 | N/A | N/A | 30453 | 30472 | TGAGCCAATATTTATAGGTG | 7 | 2093 |
| 1102575 | N/A | N/A | 30473 | 30492 | TTATACCATCAAATGTAAAA | 83 | 2094 |
| 1102576 | N/A | N/A | 30475 | 30494 | CATTATACCATCAAATGTAA | 59 | 2095 |
| 1102577 | N/A | N/A | 30477 | 30496 | TTCATTATACCATCAAATGT | 53 | 2096 |
| 1102578 | N/A | N/A | 30478 | 30497 | CTTCATTATACCATCAAATG | 30 | 2097 |
| 1102579 | N/A | N/A | 30479 | 30498 | TCTTCATTATACCATCAAAT | 9 | 2098 |
| 1102580 | N/A | N/A | 30490 | 30509 | GGTAAATATTTTCTTCATTA | 9 | 2099 |
| 1102581 | N/A | N/A | 30495 | 30514 | AAAAAGGTAAATATTTTCTT | 84 | 2100 |
| 1102582 | N/A | N/A | 30520 | 30539 | GTTGTGACTTAAAAACAAAA | 74 | 2101 |
| 1102583 | N/A | N/A | 30523 | 30542 | TGAGTTGTGACTTAAAAACA | 49 | 2102 |
| 1102584 | N/A | N/A | 30546 | 30565 | CAGAATTTTCCTTCATCTAC | 89 | 2103 |
| 1102585 | N/A | N/A | 30547 | 30566 | TCAGAATTTTCCTTCATCTA | 42 | 2104 |
| 1102586 | N/A | N/A | 30548 | 30567 | ATCAGAATTTTCCTTCATCT | 34 | 2105 |
| 1102587 | N/A | N/A | 30574 | 30593 | ATCTCACATTAAGAGGATGT | 69 | 2106 |
| 1102588 | N/A | N/A | 30576 | 30595 | ATATCTCACATTAAGAGGAT | 69 | 2107 |
| 1102589 | N/A | N/A | 30577 | 30596 | AATATCTCACATTAAGAGGA | 41 | 2108 |
| 1102591 | N/A | N/A | 30582 | 30601 | CTAGAAATATCTCACATTAA | 88 | 2109 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102593 | N/A | N/A | 30587 | 30606 | AAAGACTAGAAATATCTCAC | 46 | 2110 |
| 1102594 | N/A | N/A | 30588 | 30607 | TAAAGACTAGAAATATCTCA | 65 | 2111 |
| 1102595 | N/A | N/A | 30600 | 30619 | ATCTATACTGAATAAAGACT | 72 | 2112 |
| 1102596 | N/A | N/A | 30605 | 30624 | CATTAATCTATACTGAATAA | 98 | 2113 |
| 1102597 | N/A | N/A | 30606 | 30625 | CCATTAATCTATACTGAATA | 64 | 2114 |
| 1102598 | N/A | N/A | 30607 | 30626 | GCCATTAATCTATACTGAAT | 19 | 2115 |
| 1102599 | N/A | N/A | 30608 | 30627 | AGCCATTAATCTATACTGAA | 7 | 2116 |
| 1102600 | N/A | N/A | 30609 | 30628 | TAGCCATTAATCTATACTGA | 25 | 2117 |
| 1102601 | N/A | N/A | 30610 | 30629 | TTAGCCATTAATCTATACTG | 80 | 2118 |
| 1102602 | N/A | N/A | 30611 | 30630 | ATTAGCCATTAATCTATACT | 65 | 2119 |
| 1102603 | N/A | N/A | 30613 | 30632 | TAATTAGCCATTAATCTATA | 66 | 2120 |
| 1102604 | N/A | N/A | 30614 | 30633 | ATAATTAGCCATTAATCTAT | 69 | 2121 |
| 1102605 | N/A | N/A | 30616 | 30635 | ATATAATTAGCCATTAATCT | 63 | 2122 |
| 1102606 | N/A | N/A | 30625 | 30644 | AAATTTAACATATAATTAGC | 89 | 2123 |
| 1102607 | N/A | N/A | 30632 | 30651 | TACTTTGAAATTTAACATAT | 92 | 2124 |
| 1102608 | N/A | N/A | 30651 | 30670 | AAAAAGCACTAATAAGCACT | 59 | 2125 |
| 1102609 | N/A | N/A | 30659 | 30678 | TTAAAAGTAAAAAGCACTAA | 91 | 2126 |
| 1102610 | N/A | N/A | 30675 | 30694 | AAGTTAATTTTGAAACTTAA | 118 | 2127 |
| 1102611 | N/A | N/A | 30697 | 30716 | TTTGGAGTTTATTATAATAA | 55 | 2128 |
| 1102612 | N/A | N/A | 30723 | 30742 | TGCTAGTTTTTCTACTTTTG | 13 | 2129 |
| 1102613 | N/A | N/A | 31103 | 31122 | ATGGGAGTATTATAAAACGA | 38 | 2130 |
| 1102614 | N/A | N/A | 31121 | 31140 | CAGTGGAAAGAATGGGAGAT | 48 | 2131 |
| 1102615 | N/A | N/A | 31147 | 31166 | AAAATAATCCAAACTTGCAG | 36 | 2132 |
| 1102616 | N/A | N/A | 31150 | 31169 | TACAAAATAATCCAAACTTG | 84 | 2133 |
| 1102617 | N/A | N/A | 31152 | 31171 | GTTACAAAATAATCCAAACT | 71 | 2134 |
| 1102618 | N/A | N/A | 31153 | 31172 | TGTTACAAAATAATCCAAAC | 82 | 2135 |
| 1102619 | N/A | N/A | 31154 | 31173 | TTGTTACAAAATAATCCAAA | 80 | 2136 |
| 1102620 | N/A | N/A | 31179 | 31198 | TATAGAATAATATGATGATT | 81 | 2137 |
| 1102621 | N/A | N/A | 31197 | 31216 | GACACATATTAAAATGGTTA | 25 | 2138 |
| 1102622 | N/A | N/A | 31237 | 31256 | GCATTTAACTATGTTAAAAA | 77 | 2139 |
| 1102623 | N/A | N/A | 31238 | 31257 | AGCATTTAACTATGTTAAAA | 88 | 2140 |
| 1102624 | N/A | N/A | 31240 | 31259 | ATAGCATTTAACTATGTTAA | 85 | 2141 |
| 1102625 | N/A | N/A | 31251 | 31270 | ATTTTATGACAATAGCATTT | 28 | 2142 |
| 1102627 | N/A | N/A | 31285 | 31304 | TGATATAGAATTACAATTAA | 112 | 2143 |
| 1102629 | N/A | N/A | 31647 | 31666 | AAGTAGATTTAAGTTATTTT | 118 | 2144 |
| 1102630 | N/A | N/A | 31650 | 31669 | ATTAAGTAGATTTAAGTTAT | 136 | 2145 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102631 | N/A | N/A | 31657 | 31676 | TTTTCTAATTAAGTAGATTT | 95 | 2146 |
| 1102632 | N/A | N/A | 31659 | 31678 | GTTTTTCTAATTAAGTAGAT | 103 | 2147 |
| 1102633 | N/A | N/A | 31660 | 31679 | AGTTTTTCTAATTAAGTAGA | 72 | 2148 |
| 1102634 | N/A | N/A | 31662 | 31681 | TTAGTTTTTCTAATTAAGTA | 123 | 2149 |
| 1102635 | N/A | N/A | 31664 | 31683 | TGTTAGTTTTTCTAATTAAG | 73 | 2150 |
| 1102636 | N/A | N/A | 32030 | 32049 | TGCTTTAATTTCTATATTTC | 71 | 2151 |
| 1102637 | N/A | N/A | 32676 | 32695 | GCCAAAATACTAACATCAGT | 110 | 2152 |
| 1102638 | N/A | N/A | 32677 | 32696 | TGCCAAAATACTAACATCAG | 42 | 2153 |
| 1102639 | N/A | N/A | 32678 | 32697 | GTGCCAAAATACTAACATCA | 26 | 2154 |
| 1102640 | N/A | N/A | 32679 | 32698 | TGTGCCAAAATACTAACATC | 52 | 2155 |
| 1102641 | N/A | N/A | 32680 | 32699 | ATGTGCCAAAATACTAACAT | 42 | 2156 |
| 1102642 | N/A | N/A | 32682 | 32701 | GAATGTGCCAAAATACTAAC | 36 | 2157 |
| 1102643 | N/A | N/A | 32683 | 32702 | AGAATGTGCCAAAATACTAA | 47 | 2158 |
| 1102644 | N/A | N/A | 32691 | 32710 | ACAGAAAAAGAATGTGCCAA | 48 | 2159 |
| 1102645 | N/A | N/A | 32726 | 32745 | GAGTACAACACTTACAAGGT | 24 | 2160 |
| 1102646 | N/A | N/A | 32750 | 32769 | AGACTATTTACTGTCATAGG | 15 | 2161 |
| 1102647 | N/A | N/A | 32752 | 32771 | AAAGACTATTTACTGTCATA | 54 | 2162 |
| 1102648 | N/A | N/A | 32754 | 32773 | ACAAAGACTATTTACTGTCA | 44 | 2163 |
| 1102649 | N/A | N/A | 32762 | 32781 | AGCCTGTTACAAAGACTATT | 64 | 2164 |
| 1102650 | N/A | N/A | 32777 | 32796 | TATGAAATATCATGCAGCCT | 47 | 2165 |
| 1102651 | N/A | N/A | 32778 | 32797 | TTATGAAATATCATGCAGCC | 63 | 2166 |
| 1102652 | N/A | N/A | 32786 | 32805 | CATTCATTTTATGAAATATC | 93 | 2167 |
| 1102653 | N/A | N/A | 32807 | 32826 | ACATATAAATTATGCCACAT | 49 | 2168 |
| 1102654 | N/A | N/A | 32826 | 32845 | AGCAGAATTCAAAAGGCTCA | 65 | 2169 |
| 1102655 | N/A | N/A | 32864 | 32883 | GCAATATAAGAATTGTTCAT | 19 | 2170 |
| 1102656 | N/A | N/A | 32933 | 32952 | TCCTTTAACCCAATAATCTG | 91 | 2171 |
| 1102657 | N/A | N/A | 32940 | 32959 | GTTCATATCCTTTAACCCAA | 8 | 2172 |
| 1102658 | N/A | N/A | 32975 | 32994 | AGCAATTTAGAAATCTGTTC | 68 | 2173 |
| 1102659 | N/A | N/A | 32993 | 33012 | ATGGGAATTATTCTGGAAAG | 40 | 2174 |
| 1102660 | N/A | N/A | 33005 | 33024 | TGAAAGTATCACATGGGAAT | 39 | 2175 |
| 1102661 | N/A | N/A | 33013 | 33032 | AAACATGGTGAAAGTATCAC | 33 | 2176 |
| 1102663 | N/A | N/A | 33370 | 33389 | GATGTATGTCTTTAGACCAT | 25 | 2177 |
| 1102665 | N/A | N/A | 33447 | 33466 | GCAGTTTATTTTTATGCTTT | 40 | 2178 |
| 1102666 | N/A | N/A | 33492 | 33511 | GTTTCATATTTTTAATCCAG | 7 | 2179 |
| 1102667 | N/A | N/A | 33497 | 33516 | TGGAAGTTTCATATTTTTAA | 14 | 2180 |
| 1102668 | N/A | N/A | 33498 | 33517 | TTGGAAGTTTCATATTTTTA | 18 | 2181 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102669 | N/A | N/A | 33875 | 33894 | ACTTACTTAGTCATTATTGG | 27 | 2182 |
| 1102670 | N/A | N/A | 33880 | 33899 | TTATAACTTACTTAGTCATT | 55 | 2183 |
| 1102671 | N/A | N/A | 33882 | 33901 | TGTTATAACTTACTTAGTCA | 27 | 2184 |
| 1102672 | N/A | N/A | 33884 | 33903 | CTTGTTATAACTTACTTAGT | 48 | 2185 |
| 1102673 | N/A | N/A | 33921 | 33940 | TGTTTACTAAAAAGCACTAG | 94 | 2186 |
| 1102674 | N/A | N/A | 33922 | 33941 | CTGTTTACTAAAAAGCACTA | 102 | 2187 |
| 1102675 | N/A | N/A | 33923 | 33942 | CCTGTTTACTAAAAAGCACT | 105 | 2188 |
| 1102676 | N/A | N/A | 33925 | 33944 | ACCCTGTTTACTAAAAAGCA | 110 | 2189 |
| 1102677 | N/A | N/A | 33956 | 33975 | GAACATTTTTAAAAGGGTAC | 13 | 2190 |
| 1102678 | N/A | N/A | 33957 | 33976 | CGAACATTTTTAAAAGGGTA | 15 | 2191 |
| 1102679 | N/A | N/A | 33959 | 33978 | TTCGAACATTTTTAAAAGGG | 22 | 2192 |
| 1102680 | N/A | N/A | 33973 | 33992 | GAGGTATATCGATATTCGAA | 41 | 2193 |
| 1102681 | N/A | N/A | 33993 | 34012 | ATCCTCCACCAAGTAGGAAG | 78 | 2194 |
| 1102682 | N/A | N/A | 34001 | 34020 | CTCAATCAATCCTCCACCAA | 97 | 2195 |
| 1102683 | N/A | N/A | 34014 | 34033 | GCACACTTTCCTCCTCAATC | 15 | 2196 |
| 1102684 | N/A | N/A | 34030 | 34049 | GCTGGTAACCATCACTGCAC | 12 | 2197 |
| 1102685 | N/A | N/A | 34031 | 34050 | AGCTGGTAACCATCACTGCA | 79 | 2198 |
| 1102686 | N/A | N/A | 34051 | 34070 | AAGTCAAGCCAAGAGGCTGA | 88 | 2199 |
| 1102687 | N/A | N/A | 34053 | 34072 | CAAAGTCAAGCCAAGAGGCT | 83 | 2200 |
| 1102688 | N/A | N/A | 34058 | 34077 | ATTTGCAAAGTCAAGCCAAG | 55 | 2201 |
| 1102689 | N/A | N/A | 34071 | 34090 | AATTCTCACCAGTATTTGCA | 45 | 2202 |
| 1102690 | N/A | N/A | 34082 | 34101 | AGCTCTTTCCAAATTCTCAC | 24 | 2203 |
| 1102691 | N/A | N/A | 34095 | 34114 | TAAGATATTCTCAAGCTCTT | 40 | 2204 |
| 1102692 | N/A | N/A | 34097 | 34116 | TGTAAGATATTCTCAAGCTC | 29 | 2205 |
| 1102693 | N/A | N/A | 34100 | 34119 | CTATGTAAGATATTCTCAAG | 58 | 2206 |
| 1102694 | N/A | N/A | 34102 | 34121 | GACTATGTAAGATATTCTCA | 31 | 2207 |
| 1102695 | N/A | N/A | 34111 | 34130 | GCAACATGTGACTATGTAAG | 16 | 2208 |
| 1102696 | N/A | N/A | 34130 | 34149 | TAGTTCTTAACTCTTCTCAG | 34 | 2209 |
| 1102697 | N/A | N/A | 34133 | 34152 | AGTTAGTTCTTAACTCTTCT | 39 | 2210 |
| 1102699 | N/A | N/A | 34147 | 34166 | AATGAACATCAAGAAGTTAG | 54 | 2211 |
| 1102701 | N/A | N/A | 34228 | 34247 | AATTTTAGTGAAAGGCAAAT | 84 | 2212 |
| 1102702 | N/A | N/A | 34235 | 34254 | AATCAGGAATTTTAGTGAAA | 53 | 2213 |
| 1102703 | N/A | N/A | 34241 | 34260 | CTAAGTAATCAGGAATTTTA | 106 | 2214 |
| 1102704 | N/A | N/A | 34277 | 34296 | AAAGACAGAACCTAGAGAGA | 83 | 2215 |
| 1102705 | N/A | N/A | 34287 | 34306 | CCAAGCTCCCAAAGACAGAA | 52 | 2216 |
| 1102706 | N/A | N/A | 34304 | 34323 | GCTTGATAACCTTAGACCCA | 37 | 2217 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102707 | N/A | N/A | 34402 | 34421 | CAAATACTCAAAAAGGGAAA | 47 | 2218 |
| 1102708 | N/A | N/A | 34403 | 34422 | TCAAATACTCAAAAAGGGAA | 75 | 2219 |
| 1102709 | N/A | N/A | 34405 | 34424 | CTTCAAATACTCAAAAAGGG | 107 | 2220 |
| 1102710 | N/A | N/A | 34406 | 34425 | GCTTCAAATACTCAAAAAGG | 45 | 2221 |
| 1102711 | N/A | N/A | 34407 | 34426 | AGCTTCAAATACTCAAAAAG | 69 | 2222 |
| 1102712 | N/A | N/A | 34411 | 34430 | ATGAAGCTTCAAATACTCAA | 71 | 2223 |
| 1102713 | N/A | N/A | 34424 | 34443 | TACTATATTCAGTATGAAGC | 33 | 2224 |
| 1102714 | N/A | N/A | 34425 | 34444 | TTACTATATTCAGTATGAAG | 59 | 2225 |
| 1102715 | N/A | N/A | 34427 | 34446 | GATTACTATATTCAGTATGA | 48 | 2226 |
| 1102716 | N/A | N/A | 34429 | 34448 | ATGATTACTATATTCAGTAT | 52 | 2227 |
| 1102717 | N/A | N/A | 34431 | 34450 | CTATGATTACTATATTCAGT | 31 | 2228 |
| 1102718 | N/A | N/A | 34432 | 34451 | ACTATGATTACTATATTCAG | 38 | 2229 |
| 1102719 | N/A | N/A | 34433 | 34452 | TACTATGATTACTATATTCA | 65 | 2230 |
| 1102720 | N/A | N/A | 34436 | 34455 | GAATACTATGATTACTATAT | 37 | 2231 |
| 1102721 | N/A | N/A | 34437 | 34456 | TGAATACTATGATTACTATA | 89 | 2232 |
| 1102722 | N/A | N/A | 34440 | 34459 | GCATGAATACTATGATTACT | 6 | 2233 |
| 1102723 | N/A | N/A | 34455 | 34474 | TATGATTTTCTTTATGCATG | 9 | 2234 |
| 1102724 | N/A | N/A | 34456 | 34475 | TTATGATTTTCTTTATGCAT | 29 | 2235 |
| 1102725 | N/A | N/A | 34465 | 34484 | GCAATTACTTTATGATTTTC | 12 | 2236 |
| 1102726 | N/A | N/A | 34467 | 34486 | ATGCAATTACTTTATGATTT | 15 | 2237 |
| 1102727 | N/A | N/A | 34468 | 34487 | TATGCAATTACTTTATGATT | 62 | 2238 |
| 1102728 | N/A | N/A | 34469 | 34488 | TTATGCAATTACTTTATGAT | 72 | 2239 |
| 1102729 | N/A | N/A | 34470 | 34489 | TTTATGCAATTACTTTATGA | 100 | 2240 |
| 1102730 | N/A | N/A | 34486 | 34505 | ATGATTACTTTATGCATTTA | 91 | 2241 |
| 1102731 | N/A | N/A | 34488 | 34507 | CTATGATTACTTTATGCATT | 57 | 2242 |
| 1102732 | N/A | N/A | 34493 | 34512 | GAAAACTATGATTACTTTAT | 83 | 2243 |
| 1102733 | N/A | N/A | 34494 | 34513 | TGAAAACTATGATTACTTTA | 65 | 2244 |
| 1102735 | N/A | N/A | 34498 | 34517 | TGCATGAAAACTATGATTAC | 59 | 2245 |
| 1102737 | N/A | N/A | 34511 | 34530 | CTAGTTTTTTAATGCATGA | 34 | 2246 |
| 1102738 | N/A | N/A | 34512 | 34531 | ACTAGTTTTTTAATGCATG | 76 | 2247 |
| 1102739 | N/A | N/A | 34513 | 34532 | AACTAGTTTTTTAATGCAT | 74 | 2248 |
| 1102740 | N/A | N/A | 34851 | 34870 | ATAAATTATGAATCTGTAAT | 108 | 2249 |
| 1102741 | N/A | N/A | 34855 | 34874 | ACTCATAAATTATGAATCTG | 53 | 2250 |
| 1102742 | N/A | N/A | 34856 | 34875 | GACTCATAAATTATGAATCT | 86 | 2251 |
| 1102743 | N/A | N/A | 34857 | 34876 | TGACTCATAAATTATGAATC | 99 | 2252 |
| 1102744 | N/A | N/A | 34861 | 34880 | TTAATGACTCATAAATTATG | 101 | 2253 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102745 | N/A | N/A | 34877 | 34896 | GGCTTGAAAATATTATTTAA | 83 | 2254 |
| 1102746 | N/A | N/A | 34894 | 34913 | GCTGGAAAAAATGTCATGGC | 40 | 2255 |
| 1102747 | N/A | N/A | 34895 | 34914 | TGCTGGAAAAAATGTCATGG | 45 | 2256 |
| 1102748 | N/A | N/A | 34917 | 34936 | GTAAAACAGATTTAGAGACT | 68 | 2257 |
| 1102749 | N/A | N/A | 34919 | 34938 | TGGTAAAACAGATTTAGAGA | 36 | 2258 |
| 1102750 | N/A | N/A | 34971 | 34990 | GGTTTTACAGTGACACAGCT | 19 | 2259 |
| 1102751 | N/A | N/A | 35004 | 35023 | TTGCTTAATTTCATGCTTCT | 71 | 2260 |
| 1102752 | N/A | N/A | 35021 | 35040 | AAATAGTTTCACACACATTG | 27 | 2261 |
| 1102753 | N/A | N/A | 35023 | 35042 | TAAAATAGTTTCACACACAT | 63 | 2262 |
| 1102754 | N/A | N/A | 35025 | 35044 | TATAAAATAGTTTCACACAC | 69 | 2263 |
| 1102755 | N/A | N/A | 35061 | 35080 | AACTGCCAACATGTATGTAT | 42 | 2264 |
| 1102756 | N/A | N/A | 35094 | 35113 | CATTTCAAAGCCACACCTAG | 106 | 2265 |
| 1102757 | N/A | N/A | 35098 | 35117 | CATCCATTTCAAAGCCACAC | 44 | 2266 |
| 1102758 | N/A | N/A | 35174 | 35193 | TGTCCATGAAGATATTTGTG | 31 | 2267 |
| 1102759 | N/A | N/A | 35185 | 35204 | ATAGCAATCCATGTCCATGA | 10 | 2268 |
| 1102760 | N/A | N/A | 35186 | 35205 | CATAGCAATCCATGTCCATG | 22 | 2269 |
| 1102761 | N/A | N/A | 35187 | 35206 | TCATAGCAATCCATGTCCAT | 38 | 2270 |
| 1102762 | N/A | N/A | 35203 | 35222 | TTAGGCAATCAAACACTCAT | 73 | 2271 |
| 1102763 | N/A | N/A | 35240 | 35259 | TAAATTATACCATATCACTG | 88 | 2272 |
| 1102764 | N/A | N/A | 35243 | 35262 | TGATAAATTATACCATATCA | 110 | 2273 |
| 1102765 | N/A | N/A | 35247 | 35266 | TGTTTGATAAATTATACCAT | 79 | 2274 |
| 1102766 | N/A | N/A | 35264 | 35283 | TTTCTGTTTCTCAACACTGT | 77 | 2275 |
| 1102767 | N/A | N/A | 35286 | 35305 | CTCTTTAAAACATCCCCAGT | 95 | 2276 |
| 1102768 | N/A | N/A | 35290 | 35309 | TTTCCTCTTTAAAACATCCC | 37 | 2277 |
| 1102769 | N/A | N/A | 35321 | 35340 | TATGTAAACCCCTAATTTCT | 100 | 2278 |
| 1102771 | N/A | N/A | 35332 | 35351 | TTTCTTAAGATTATGTAAAC | 146 | 2279 |
| 1102773 | N/A | N/A | 35440 | 35459 | TTTAATATCCTCATTACCCA | 52 | 2280 |
| 1102774 | N/A | N/A | 35441 | 35460 | ATTTAATATCCTCATTACCC | 77 | 2281 |
| 1102775 | N/A | N/A | 35442 | 35461 | AATTTAATATCCTCATTACC | 71 | 2282 |
| 1102776 | N/A | N/A | 35446 | 35465 | CTTAAATTTAATATCCTCAT | 67 | 2283 |
| 1102777 | N/A | N/A | 35448 | 35467 | TTCTTAAATTTAATATCCTC | 75 | 2284 |
| 1102778 | N/A | N/A | 35450 | 35469 | TGTTCTTAAATTTAATATCC | 50 | 2285 |
| 1102779 | N/A | N/A | 35484 | 35503 | GCTTTCTATGCCAAGGATCA | 36 | 2286 |
| 1102780 | N/A | N/A | 35562 | 35581 | AGTCCCAAAATTCTGCTTCA | 127 | 2287 |
| 1102781 | N/A | N/A | 35566 | 35585 | TGCCAGTCCCAAAATTCTGC | 94 | 2288 |
| 1102782 | N/A | N/A | 35588 | 35607 | GCAAGCAAAGCCATTTGGGA | 80 | 2289 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102783 | N/A | N/A | 36442 | 36461 | CTAAAAATACAAACCTTGTC | 73 | 2290 |
| 1102784 | N/A | N/A | 36582 | 36601 | CATGAGCTTTAAAAAGCAGA | 153 | 2291 |
| 1102785 | N/A | N/A | 36603 | 36622 | TGGTTACAAATTAAGTGCTC | 79 | 2292 |
| 1102786 | N/A | N/A | 36604 | 36623 | CTGGTTACAAATTAAGTGCT | 64 | 2293 |
| 1102787 | N/A | N/A | 36606 | 36625 | TTCTGGTTACAAATTAAGTG | 37 | 2294 |
| 1102788 | N/A | N/A | 36624 | 36643 | ATTATTTTACAAGTAGGATT | 86 | 2295 |
| 1102789 | N/A | N/A | 36627 | 36646 | TAGATTATTTTACAAGTAGG | 15 | 2296 |
| 1102790 | N/A | N/A | 36628 | 36647 | TTAGATTATTTTACAAGTAG | 65 | 2297 |
| 1102791 | N/A | N/A | 36629 | 36648 | CTTAGATTATTTTACAAGTA | 55 | 2298 |
| 1102792 | N/A | N/A | 36634 | 36653 | CATGTCTTAGATTATTTTAC | 38 | 2299 |
| 1102793 | N/A | N/A | 36658 | 36677 | TAGAGGTTACAAAGCTAAAA | 31 | 2300 |
| 1102794 | N/A | N/A | 36670 | 36689 | CCATCAATATTATAGAGGTT | 7 | 2301 |
| 1102795 | N/A | N/A | 36734 | 36753 | TCCAGCTGTGAAGACACTGA | 103 | 2302 |
| 1102796 | N/A | N/A | 36757 | 36776 | ACCTTGAAACAATGTAGACA | 71 | 2303 |
| 1102797 | N/A | N/A | 36797 | 36816 | ACTTTTAGTTTATGAAAAAT | 96 | 2304 |
| 1102798 | N/A | N/A | 36799 | 36818 | CTACTTTTAGTTTATGAAAA | 105 | 2305 |
| 1102799 | N/A | N/A | 36804 | 36823 | TTATTCTACTTTTAGTTTAT | 75 | 2306 |
| 1102800 | N/A | N/A | 36807 | 36826 | CCTTTATTCTACTTTTAGTT | 53 | 2307 |
| 1102801 | N/A | N/A | 36808 | 36827 | GCCTTTATTCTACTTTTAGT | 22 | 2308 |
| 1102802 | N/A | N/A | 36811 | 36830 | ATAGCCTTTATTCTACTTTT | 17 | 2309 |
| 1102803 | N/A | N/A | 36815 | 36834 | AGGAATAGCCTTTATTCTAC | 57 | 2310 |
| 1102804 | N/A | N/A | 36817 | 36836 | AGAGGAATAGCCTTTATTCT | 51 | 2311 |
| 1102805 | N/A | N/A | 36830 | 36849 | AGATAGCAATTTTAGAGGAA | 30 | 2312 |
| 1102807 | N/A | N/A | 36973 | 36992 | CCCATTAGCAAATCCTGATG | 72 | 2313 |
| 1102809 | N/A | N/A | 37096 | 37115 | AGAAAGTTCAACTAATGAGA | 87 | 2314 |
| 1102810 | N/A | N/A | 37124 | 37143 | TTTTGTGTTTTAAAACTGTG | 61 | 2315 |
| 1102811 | N/A | N/A | 37153 | 37172 | TGGCACATTTTTTATAGAGT | 4 | 2316 |
| 1102812 | N/A | N/A | 37171 | 37190 | CAACAATTATTAATAGAATG | 81 | 2317 |
| 1102813 | N/A | N/A | 37172 | 37191 | GCAACAATTATTAATAGAAT | 77 | 2318 |
| 1102814 | N/A | N/A | 37173 | 37192 | AGCAACAATTATTAATAGAA | 109 | 2319 |
| 1102815 | N/A | N/A | 37174 | 37193 | CAGCAACAATTATTAATAGA | 48 | 2320 |
| 1102816 | N/A | N/A | 37176 | 37195 | ACCAGCAACAATTATTAATA | 55 | 2321 |
| 1102817 | N/A | N/A | 37177 | 37196 | TACCAGCAACAATTATTAAT | 106 | 2322 |
| 1102818 | N/A | N/A | 37185 | 37204 | TTTTAAATTACCAGCAACAA | 71 | 2323 |
| 1102819 | N/A | N/A | 37187 | 37206 | ATTTTTAAATTACCAGCAAC | 52 | 2324 |
| 1102820 | N/A | N/A | 37191 | 37210 | AAGGATTTTTAAATTACCAG | 35 | 2325 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102821 | N/A | N/A | 37194 | 37213 | AACAAGGATTTTTAAATTAC | 81 | 2326 |
| 1102822 | N/A | N/A | 37317 | 37336 | GCTGACAATCTCAGTGAGAA | 76 | 2327 |
| 1102823 | N/A | N/A | 37321 | 37340 | AACAGCTGACAATCTCAGTG | 58 | 2328 |
| 1102824 | N/A | N/A | 37330 | 37349 | AAACTTACAAACAGCTGACA | 66 | 2329 |
| 1102825 | N/A | N/A | 37332 | 37351 | CAAAACTTACAAACAGCTGA | 58 | 2330 |
| 1102826 | N/A | N/A | 37341 | 37360 | ACCAAAAACCAAAACTTACA | 89 | 2331 |
| 1102827 | N/A | N/A | 37342 | 37361 | AACCAAAAACCAAAACTTAC | 84 | 2332 |
| 1102828 | N/A | N/A | 37437 | 37456 | CTAAAAAACCCCAAATCTAA | 87 | 2333 |
| 1102829 | N/A | N/A | 37438 | 37457 | CCTAAAAAACCCCAAATCTA | 104 | 2334 |
| 1102830 | N/A | N/A | 37439 | 37458 | TCCTAAAAAACCCCAAATCT | 75 | 2335 |
| 1102831 | N/A | N/A | 37448 | 37467 | ATTCACAAATCCTAAAAAAC | 92 | 2336 |
| 1102832 | N/A | N/A | 37454 | 37473 | GCAAATATTCACAAATCCTA | 30 | 2337 |
| 1102833 | N/A | N/A | 37456 | 37475 | GTGCAAATATTCACAAATCC | 30 | 2338 |
| 1102834 | N/A | N/A | 37457 | 37476 | AGTGCAAATATTCACAAATC | 27 | 2339 |
| 1102835 | N/A | N/A | 37459 | 37478 | ATAGTGCAAATATTCACAAA | 33 | 2340 |
| 1102836 | N/A | N/A | 37535 | 37554 | CATGATACTCAAAAGAGGTG | 85 | 2341 |
| 1102837 | N/A | N/A | 37597 | 37616 | CATCCTAAATCCGAGAATCA | 100 | 2342 |
| 1102838 | N/A | N/A | 37601 | 37620 | CAAGCATCCTAAATCCGAGA | 90 | 2343 |
| 1102839 | N/A | N/A | 37618 | 37637 | AATCTGAAATTACAGGTCAA | 89 | 2344 |
| 1102840 | N/A | N/A | 37620 | 37639 | TAAATCTGAAATTACAGGTC | 90 | 2345 |
| 1102841 | N/A | N/A | 37633 | 37652 | TTCTGCTTTTATGTAAATCT | 20 | 2346 |
| 1102843 | N/A | N/A | 37711 | 37730 | CATATTATTCCCAAATGGTT | 53 | 2347 |
| 1102845 | N/A | N/A | 37762 | 37781 | ACTTAGAAAATATACACTGA | 82 | 2348 |
| 1102846 | N/A | N/A | 37764 | 37783 | GTACTTAGAAAATATACACT | 43 | 2349 |
| 1102847 | N/A | N/A | 37779 | 37798 | TAGGAATATATTCTTGTACT | 37 | 2350 |
| 1102848 | N/A | N/A | 37783 | 37802 | TATGTAGGAATATATTCTTG | 25 | 2351 |
| 1102849 | N/A | N/A | 37816 | 37835 | TAAAATGTTTAAACATGACG | 78 | 2352 |
| 1102850 | N/A | N/A | 37825 | 37844 | TCCCCATTTTAAAATGTTTA | 79 | 2353 |
| 1102851 | N/A | N/A | 37834 | 37853 | TAATACAAATCCCCATTTTA | 78 | 2354 |
| 1102852 | N/A | N/A | 37838 | 37857 | AATGTAATACAAATCCCCAT | 58 | 2355 |
| 1102853 | N/A | N/A | 37900 | 37919 | ATCAGATTTTAAGTAATACT | 85 | 2356 |
| 1102854 | N/A | N/A | 37903 | 37922 | ATTATCAGATTTTAAGTAAT | 87 | 2357 |
| 1102855 | N/A | N/A | 37906 | 37925 | CACATTATCAGATTTTAAGT | 69 | 2358 |
| 1102856 | N/A | N/A | 37907 | 37926 | ACACATTATCAGATTTTAAG | 48 | 2359 |
| 1102857 | N/A | N/A | 37908 | 37927 | CACACATTATCAGATTTTAA | 67 | 2360 |
| 1102858 | N/A | N/A | 37913 | 37932 | TTTAACACACATTATCAGAT | 67 | 2361 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102859 | N/A | N/A | 37917 | 37936 | ACTATTTAACACACATTATC | 85 | 2362 |
| 1102860 | N/A | N/A | 37919 | 37938 | CTACTATTTAACACACATTA | 65 | 2363 |
| 1102861 | N/A | N/A | 37922 | 37941 | AAACTACTATTTAACACACA | 60 | 2364 |
| 1102862 | N/A | N/A | 37923 | 37942 | AAAACTACTATTTAACACAC | 107 | 2365 |
| 1102863 | N/A | N/A | 37927 | 37946 | AATGAAAACTACTATTTAAC | 84 | 2366 |
| 1102864 | N/A | N/A | 38009 | 38028 | TATCTTACTCATCTATTTCC | 70 | 2367 |
| 1102865 | N/A | N/A | 38053 | 38072 | TATTTCCCTCTTTATGGCAT | 36 | 2368 |
| 1102866 | N/A | N/A | 38116 | 38135 | CCCATTATTTCATCACTTCA | 42 | 2369 |
| 1102867 | N/A | N/A | 38123 | 38142 | TGACATTCCCATTATTTCAT | 64 | 2370 |
| 1102868 | N/A | N/A | 38146 | 38165 | CCATCCCACCAAAAGTAGCC | 86 | 2371 |
| 1102869 | N/A | N/A | 38183 | 38202 | AGCTTAAAATTTATCTCCCC | 69 | 2372 |
| 1102870 | N/A | N/A | 38184 | 38203 | GAGCTTAAAATTTATCTCCC | 60 | 2373 |
| 1102871 | N/A | N/A | 38225 | 38244 | ATAATGTTTCCATGGCTGGC | 69 | 2374 |
| 1102872 | N/A | N/A | 38234 | 38253 | TGAGTTAACATAATGTTTCC | 45 | 2375 |
| 1102873 | N/A | N/A | 38236 | 38255 | TGTGAGTTAACATAATGTTT | 53 | 2376 |
| 1102874 | N/A | N/A | 38247 | 38266 | TCAAACTACCATGTGAGTTA | 93 | 2377 |
| 1102875 | N/A | N/A | 38251 | 38270 | CATTTCAAACTACCATGTGA | 101 | 2378 |
| 1102876 | N/A | N/A | 38252 | 38271 | GCATTTCAAACTACCATGTG | 46 | 2379 |
| 1102877 | N/A | N/A | 38255 | 38274 | AAAGCATTTCAAACTACCAT | 48 | 2380 |
| 1102879 | N/A | N/A | 38286 | 38305 | AGTCACCAAAAATAAGTACC | 66 | 2381 |
| 1102881 | N/A | N/A | 38294 | 38313 | TTGTTGAAAGTCACCAAAAA | 65 | 2382 |
| 1102882 | N/A | N/A | 38304 | 38323 | ACCCTTAATATTGTTGAAAG | 54 | 2383 |
| 1102883 | N/A | N/A | 38306 | 38325 | AGACCCTTAATATTGTTGAA | 53 | 2384 |
| 1102884 | N/A | N/A | 38311 | 38330 | TTTATAGACCCTTAATATTG | 82 | 2385 |
| 1102885 | N/A | N/A | 38357 | 38376 | TACAAAAAGATTCACTGGTA | 59 | 2386 |
| 1102886 | N/A | N/A | 38359 | 38378 | CATACAAAAAGATTCACTGG | 93 | 2387 |
| 1102887 | N/A | N/A | 38362 | 38381 | TATCATACAAAAAGATTCAC | 70 | 2388 |
| 1102888 | N/A | N/A | 38364 | 38383 | CCTATCATACAAAAAGATTC | 76 | 2389 |
| 1102889 | N/A | N/A | 38368 | 38387 | AAAACCTATCATACAAAAAG | 92 | 2390 |
| 1102890 | N/A | N/A | 38374 | 38393 | AAACAAAAAACCTATCATAC | 105 | 2391 |
| 1102891 | N/A | N/A | 38681 | 38700 | AATAACCTATCATGGCCAGG | 66 | 2392 |
| 1102892 | N/A | N/A | 38686 | 38705 | CACAAAATAACCTATCATGG | 94 | 2393 |
| 1102893 | N/A | N/A | 38687 | 38706 | TCACAAAATAACCTATCATG | 70 | 2394 |
| 1102894 | N/A | N/A | 38689 | 38708 | CATCACAAAATAACCTATCA | 75 | 2395 |
| 1102895 | N/A | N/A | 38690 | 38709 | TCATCACAAAATAACCTATC | 81 | 2396 |
| 1102896 | N/A | N/A | 38691 | 38710 | TTCATCACAAAATAACCTAT | 65 | 2397 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102897 | N/A | N/A | 38692 | 38711 | TTTCATCACAAAATAACCTA | 64 | 2398 |
| 1102898 | N/A | N/A | 38715 | 38734 | CAGACAAATTAAGAGGTAGG | 21 | 2399 |
| 1102899 | N/A | N/A | 38717 | 38736 | ATCAGACAAATTAAGAGGTA | 47 | 2400 |
| 1102900 | N/A | N/A | 38718 | 38737 | TATCAGACAAATTAAGAGGT | 48 | 2401 |
| 1102901 | N/A | N/A | 38724 | 38743 | TAAATTTATCAGACAAATTA | 106 | 2402 |
| 1102902 | N/A | N/A | 38726 | 38745 | TTTAAATTTATCAGACAAAT | 90 | 2403 |
| 1102903 | N/A | N/A | 38727 | 38746 | ATTTAAATTTATCAGACAAA | 62 | 2404 |
| 1102904 | N/A | N/A | 38730 | 38749 | AAAATTTAAATTTATCAGAC | 102 | 2405 |
| 1102905 | N/A | N/A | 38732 | 38751 | ATAAAATTTAAATTTATCAG | 115 | 2406 |
| 1102906 | N/A | N/A | 38736 | 38755 | AGACATAAAATTTAAATTTA | 106 | 2407 |
| 1102907 | N/A | N/A | 38738 | 38757 | CTAGACATAAAATTTAAATT | 89 | 2408 |
| 1102908 | N/A | N/A | 38773 | 38792 | TACTTTAAAATATGGAAGTG | 85 | 2409 |
| 1102909 | N/A | N/A | 38777 | 38796 | AGATTACTTTAAAATATGGA | 108 | 2410 |
| 1102910 | N/A | N/A | 38785 | 38804 | TCTGATACAGATTACTTTAA | 66 | 2411 |
| 1102911 | N/A | N/A | 38787 | 38806 | AGTCTGATACAGATTACTTT | 54 | 2412 |
| 1102912 | N/A | N/A | 38812 | 38831 | GTATTAAAAGAATGCAAGAG | 57 | 2413 |
| 1102913 | N/A | N/A | 38817 | 38836 | CACTGGTATTAAAAGAATGC | 66 | 2414 |
| 1102915 | N/A | N/A | 38852 | 38871 | TAAGGAAAATACATTGTTTC | 80 | 2415 |
| 1102917 | N/A | N/A | 38868 | 38887 | TGAGAAAAACTATTCATAAG | 86 | 2416 |
| 1102918 | N/A | N/A | 38869 | 38888 | ATGAGAAAAACTATTCATAA | 97 | 2417 |
| 1102919 | N/A | N/A | 38872 | 38891 | ACCATGAGAAAAACTATTCA | 64 | 2418 |
| 1102920 | N/A | N/A | 38879 | 38898 | TAAATACACCATGAGAAAAA | 101 | 2419 |
| 1102921 | N/A | N/A | 38880 | 38899 | ATAAATACACCATGAGAAAA | 68 | 2420 |
| 1102922 | N/A | N/A | 38882 | 38901 | GAATAAATACACCATGAGAA | 98 | 2421 |
| 1102923 | N/A | N/A | 38884 | 38903 | AAGAATAAATACACCATGAG | 98 | 2422 |
| 1102924 | N/A | N/A | 38885 | 38904 | AAAGAATAAATACACCATGA | 81 | 2423 |
| 1102925 | N/A | N/A | 38886 | 38905 | AAAAGAATAAATACACCATG | 109 | 2424 |
| 1102926 | N/A | N/A | 38890 | 38909 | ACTTAAAAGAATAAATACAC | 83 | 2425 |
| 1102927 | N/A | N/A | 38913 | 38932 | GTGAAGTATATTTAAAAAAC | 74 | 2426 |
| 1102928 | N/A | N/A | 38927 | 38946 | TGAAACATTCAAAAGTGAAG | 87 | 2427 |
| 1102929 | N/A | N/A | 38933 | 38952 | GCTGTCTGAAACATTCAAAA | 79 | 2428 |
| 1100520* | 986 | 1005 | 38992 | 39011 | ACTCTGTCCTGATAGGTCCC | 17 | 2429 |
| 1100521* | 988 | 1007 | 38994 | 39013 | GAACTCTGTCCTGATAGGTC | 12 | 2430 |
| 1100522* | 1030 | 1049 | 39036 | 39055 | CCAAGTGCTCCTGAACTGGT | 19 | 2431 |
| 1100523* | 1040 | 1059 | 39046 | 39065 | TAGATCACTCCCAAGTGCTC | 17 | 2432 |
| 1100524* | 1043 | 1062 | 39049 | 39068 | ACCTAGATCACTCCCAAGTG | 16 | 2433 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100525* | 1044 | 1063 | N/A | N/A | CACCTAGATCACTCCCAAGT | 18 | 2434 |
| 1100526* | 1046 | 1065 | N/A | N/A | ATCACCTAGATCACTCCCAA | 20 | 2435 |
| 1100527* | 1047 | 1066 | N/A | N/A | CATCACCTAGATCACTCCCA | 12 | 2436 |
| 1100528* | 1049 | 1068 | N/A | N/A | AGCATCACCTAGATCACTCC | 10 | 2437 |
| 1100529* | 1050 | 1069 | N/A | N/A | TAGCATCACCTAGATCACTC | 24 | 2438 |
| 1100530* | 1052 | 1071 | N/A | N/A | CATAGCATCACCTAGATCAC | 21 | 2439 |
| 1100531* | 1082 | 1101 | 45608 | 45627 | CACAGCTGCCTGAAGCATGT | 70 | 2440 |
| 1100532* | 1083 | 1102 | 45609 | 45628 | TCACAGCTGCCTGAAGCATG | 19 | 2441 |
| 1100533* | 1084 | 1103 | 45610 | 45629 | GTCACAGCTGCCTGAAGCAT | 15 | 2442 |
| 1100534* | 1085 | 1104 | 45611 | 45630 | GGTCACAGCTGCCTGAAGCA | 4 | 2443 |
| 1100535* | 1086 | 1105 | 45612 | 45631 | TGGTCACAGCTGCCTGAAGC | 6 | 2444 |
| 1100536* | 1087 | 1106 | 45613 | 45632 | ATGGTCACAGCTGCCTGAAG | 13 | 2445 |
| 1100538* | 1089 | 1108 | 45615 | 45634 | ACATGGTCACAGCTGCCTGA | 20 | 2446 |
| 1100540* | 1091 | 1110 | 45617 | 45636 | AGACATGGTCACAGCTGCCT | 7 | 2447 |
| 1100541* | 1092 | 1111 | 45618 | 45637 | AAGACATGGTCACAGCTGCC | 11 | 2448 |
| 1100542* | 1093 | 1112 | 45619 | 45638 | AAAGACATGGTCACAGCTGC | 10 | 2449 |
| 1100543* | 1094 | 1113 | 45620 | 45639 | TAAAGACATGGTCACAGCTG | 19 | 2450 |
| 1100544* | 1095 | 1114 | 45621 | 45640 | CTAAAGACATGGTCACAGCT | 15 | 2451 |
| 1100545* | 1098 | 1117 | 45624 | 45643 | TTTCTAAAGACATGGTCACA | 50 | 2452 |
| 1100546* | 1099 | 1118 | 45625 | 45644 | GTTTCTAAAGACATGGTCAC | 19 | 2453 |
| 1100547* | 1102 | 1121 | 45628 | 45647 | ACAGTTTCTAAAGACATGGT | 35 | 2454 |
| 1100548* | 1103 | 1122 | 45629 | 45648 | GACAGTTTCTAAAGACATGG | 81 | 2455 |
| 1100549* | 1104 | 1123 | 45630 | 45649 | TGACAGTTTCTAAAGACATG | 47 | 2456 |
| 1100550* | 1105 | 1124 | 45631 | 45650 | CTGACAGTTTCTAAAGACAT | 34 | 2457 |
| 1100551* | 1106 | 1125 | 45632 | 45651 | TCTGACAGTTTCTAAAGACA | 36 | 2458 |
| 1100552* | 1111 | 1130 | 45637 | 45656 | TCATTTCTGACAGTTTCTAA | 24 | 2459 |
| 1100553* | 1114 | 1133 | 45640 | 45659 | AAATCATTTCTGACAGTTTC | 29 | 2460 |
| 1100554* | 1115 | 1134 | 45641 | 45660 | CAAATCATTTCTGACAGTTT | 27 | 2461 |
| 1100555* | 1118 | 1137 | 45644 | 45663 | TTTCAAATCATTTCTGACAG | 28 | 2462 |
| 1100556* | 1119 | 1138 | 45645 | 45664 | TTTTCAAATCATTTCTGACA | 53 | 2463 |
| 1102930* | N/A | N/A | 39053 | 39072 | CCTTACCTAGATCACTCCCA | 52 | 2464 |
| 1102931* | N/A | N/A | 39126 | 39145 | AAAGCAAAAATCACATGGAG | 58 | 2465 |
| 1102932* | N/A | N/A | 39144 | 39163 | GGGAATGAAGAATAATGTAA | 24 | 2466 |
| 1102933* | N/A | N/A | 39162 | 39181 | TCTTAATATGATTAAAGAGG | 61 | 2467 |
| 1102934* | N/A | N/A | 39163 | 39182 | TTCTTAATATGATTAAAGAG | 100 | 2468 |
| 1102935* | N/A | N/A | 39184 | 39203 | AGATTACAAATTTACTTAAG | 54 | 2469 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102936* | N/A | N/A | 39185 | 39204 | TAGATTACAAATTTACTTAA | 116 | 2470 |
| 1102937* | N/A | N/A | 39187 | 39206 | AGTAGATTACAAATTTACTT | 94 | 2471 |
| 1102938* | N/A | N/A | 39192 | 39211 | AATTTAGTAGATTACAAATT | 85 | 2472 |
| 1102939* | N/A | N/A | 39200 | 39219 | TCCAGGGAAATTTAGTAGAT | 16 | 2473 |
| 1102940* | N/A | N/A | 39207 | 39226 | TCCTTAATCCAGGGAAATTT | 75 | 2474 |
| 1102941* | N/A | N/A | 39213 | 39232 | AACTGCTCCTTAATCCAGGG | 22 | 2475 |
| 1102942* | N/A | N/A | 39215 | 39234 | GTAACTGCTCCTTAATCCAG | 36 | 2476 |
| 1102943* | N/A | N/A | 39307 | 39326 | TTCTAGCAATCCTCTCCTGC | 74 | 2477 |
| 1102944* | N/A | N/A | 39339 | 39358 | TTAAATTATTATGTTAAAGT | 100 | 2478 |
| 1102945* | N/A | N/A | 39340 | 39359 | TTTAAATTATTATGTTAAAG | 87 | 2479 |
| 1102946* | N/A | N/A | 39341 | 39360 | GTTTAAATTATTATGTTAAA | 96 | 2480 |
| 1102947* | N/A | N/A | 39342 | 39361 | AGTTTAAATTATTATGTTAA | 114 | 2481 |
| 1102948* | N/A | N/A | 39343 | 39362 | AAGTTTAAATTATTATGTTA | 92 | 2482 |
| 1102949* | N/A | N/A | 39344 | 39363 | GAAGTTTAAATTATTATGTT | 86 | 2483 |
| 1102951* | N/A | N/A | 39347 | 39366 | TGTGAAGTTTAAATTATTAT | 98 | 2484 |
| 1102953* | N/A | N/A | 39362 | 39381 | GACTGTACAAATTACTGTGA | 48 | 2485 |
| 1102954* | N/A | N/A | 39364 | 39383 | GAGACTGTACAAATTACTGT | 67 | 2486 |
| 1102955* | N/A | N/A | 39704 | 39723 | TACTAATATTCATGATTTCT | 66 | 2487 |
| 1102956* | N/A | N/A | 39705 | 39724 | CTACTAATATTCATGATTTC | 76 | 2488 |
| 1102957* | N/A | N/A | 39710 | 39729 | TTCACCTACTAATATTCATG | 35 | 2489 |
| 1102958* | N/A | N/A | 39711 | 39730 | TTTCACCTACTAATATTCAT | 82 | 2490 |
| 1102959* | N/A | N/A | 39713 | 39732 | TTTTTCACCTACTAATATTC | 82 | 2491 |
| 1102960* | N/A | N/A | 39714 | 39733 | ATTTTTCACCTACTAATATT | 104 | 2492 |
| 1102961* | N/A | N/A | 39753 | 39772 | CTCAAGTATTTTTCATTTTC | 72 | 2493 |
| 1102962* | N/A | N/A | 39760 | 39779 | GATTATACTCAAGTATTTTT | 66 | 2494 |
| 1102963* | N/A | N/A | 39762 | 39781 | TAGATTATACTCAAGTATTT | 66 | 2495 |
| 1102964* | N/A | N/A | 39763 | 39782 | TTAGATTATACTCAAGTATT | 62 | 2496 |
| 1102965* | N/A | N/A | 39764 | 39783 | TTTAGATTATACTCAAGTAT | 72 | 2497 |
| 1102966* | N/A | N/A | 39767 | 39786 | TTATTTAGATTATACTCAAG | 79 | 2498 |
| 1102967* | N/A | N/A | 39769 | 39788 | TGTTATTTAGATTATACTCA | 56 | 2499 |
| 1102968* | N/A | N/A | 39774 | 39793 | CCCATTGTTATTTAGATTAT | 55 | 2500 |
| 1102969* | N/A | N/A | 39815 | 39834 | AGACATATTTAAACCGAGAC | 15 | 2501 |
| 1102970* | N/A | N/A | 39816 | 39835 | AAGACATATTTAAACCGAGA | 8 | 2502 |
| 1102971* | N/A | N/A | 39817 | 39836 | TAAGACATATTTAAACCGAG | 16 | 2503 |
| 1102972* | N/A | N/A | 39818 | 39837 | TTAAGACATATTTAAACCGA | 71 | 2504 |
| 1102973* | N/A | N/A | 39833 | 39852 | CTAATTGGCCAAAGTTTAAG | 57 | 2505 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102974* | N/A | N/A | 39844 | 39863 | AACTTCTACTACTAATTGGC | 37 | 2506 |
| 1102975* | N/A | N/A | 39850 | 39869 | TCTCTCAACTTCTACTACTA | 39 | 2507 |
| 1102976* | N/A | N/A | 39851 | 39870 | TTCTCTCAACTTCTACTACT | 60 | 2508 |
| 1102977* | N/A | N/A | 39860 | 39879 | AGTTACTTTTTCTCTCAACT | 11 | 2509 |
| 1102978* | N/A | N/A | 39883 | 39902 | TGCTTATAATTTCTTTGTCA | 10 | 2510 |
| 1102979* | N/A | N/A | 39884 | 39903 | CTGCTTATAATTTCTTTGTC | 10 | 2511 |
| 1102980* | N/A | N/A | 39885 | 39904 | TCTGCTTATAATTTCTTTGT | 11 | 2512 |
| 1102981* | N/A | N/A | 39944 | 39963 | CCTTCACCTTTTTATTGAGT | 37 | 2513 |
| 1102982* | N/A | N/A | 39952 | 39971 | TTTCAAATCCTTCACCTTTT | 43 | 2514 |
| 1102983* | N/A | N/A | 39954 | 39973 | CTTTTCAAATCCTTCACCTT | 121 | 2515 |
| 1102984* | N/A | N/A | 39958 | 39977 | ATATCTTTTCAAATCCTTCA | 44 | 2516 |
| 1102985* | N/A | N/A | 40088 | 40107 | TTCATTAAAGCCATACCTAC | 88 | 2517 |
| 1102987* | N/A | N/A | 40171 | 40190 | TACACTTTTACATTCCCATT | 16 | 2518 |
| 1102989* | N/A | N/A | 40206 | 40225 | TTATCAAAAAAATGCCAAAC | 103 | 2519 |
| 1102990* | N/A | N/A | 40207 | 40226 | TTTATCAAAAAAATGCCAAA | 111 | 2520 |
| 1102991* | N/A | N/A | 40208 | 40227 | ATTTATCAAAAAAATGCCAA | 71 | 2521 |
| 1102992* | N/A | N/A | 40210 | 40229 | ACATTTATCAAAAAAATGCC | 84 | 2522 |
| 1102993* | N/A | N/A | 40211 | 40230 | TACATTTATCAAAAAAATGC | 80 | 2523 |
| 1102994* | N/A | N/A | 40216 | 40235 | AAGTATACATTTATCAAAAA | 86 | 2524 |
| 1102995* | N/A | N/A | 40284 | 40303 | TATGTGAACCTAAGTTTTCT | 61 | 2525 |
| 1102996* | N/A | N/A | 40296 | 40315 | GATATAAGTTTTTATGTGAA | 34 | 2526 |
| 1102997* | N/A | N/A | 40957 | 40976 | AAGGTCTACATTTAGGCAGT | 75 | 2527 |
| 1102998* | N/A | N/A | 40979 | 40998 | TTGTGCATTCATTAACTAAA | 14 | 2528 |
| 1102999* | N/A | N/A | 41041 | 41060 | AGGAATAGAAAAAAGTACCA | 58 | 2529 |
| 1103000* | N/A | N/A | 41058 | 41077 | GGCTGTACTTAAACAGGAGG | 31 | 2530 |
| 1103001* | N/A | N/A | 41083 | 41102 | TTTTATACAAATGTTGAGGT | 14 | 2531 |
| 1103002* | N/A | N/A | 41085 | 41104 | TGTTTTATACAAATGTTGAG | 91 | 2532 |
| 1103003* | N/A | N/A | 41089 | 41108 | CTCATGTTTTATACAAATGT | 64 | 2533 |
| 1103004* | N/A | N/A | 41486 | 41505 | AAGAAAATCCAGTCCACTCC | 64 | 2534 |
| 1103005* | N/A | N/A | 41488 | 41507 | AAAAGAAAATCCAGTCCACT | 56 | 2535 |
| 1103006* | N/A | N/A | 41609 | 41628 | TCTAAAGGTTTTTATCTTGC | 31 | 2536 |
| 1103007* | N/A | N/A | 41616 | 41635 | CTTATTATCTAAAGGTTTTT | 68 | 2537 |
| 1103008* | N/A | N/A | 41731 | 41750 | AGAAGTGTACCTTATGACTT | 50 | 2538 |
| 1103009* | N/A | N/A | 41812 | 41831 | AGTGTTATCACCTCCTGGAG | 106 | 2539 |
| 1103010* | N/A | N/A | 41814 | 41833 | GGAGTGTTATCACCTCCTGG | 63 | 2540 |
| 1103011* | N/A | N/A | 41881 | 41900 | CAGAGAGATGCCTATGTATT | 42 | 2541 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103012* | N/A | N/A | 42140 | 42159 | GGAGTGAAAGTCCAGGTTTC | 30 | 2542 |
| 1103013* | N/A | N/A | 42220 | 42239 | CATCTTCCAATTTAGCAAGC | 82 | 2543 |
| 1103014* | N/A | N/A | 42232 | 42251 | GAATCTTATTTACATCTTCC | 12 | 2544 |
| 1103015* | N/A | N/A | 42233 | 42252 | TGAATCTTATTTACATCTTC | 27 | 2545 |
| 1103016* | N/A | N/A | 42234 | 42253 | GTGAATCTTATTTACATCTT | 28 | 2546 |
| 1103017* | N/A | N/A | 42236 | 42255 | ATGTGAATCTTATTTACATC | 79 | 2547 |
| 1103018* | N/A | N/A | 42280 | 42299 | ATTTTCAATTAAATCCTGAA | 66 | 2548 |
| 1103019* | N/A | N/A | 42283 | 42302 | GTGATTTTCAATTAAATCCT | 70 | 2549 |
| 1103020* | N/A | N/A | 42579 | 42598 | CTGACACAAATTTAGATGGA | 64 | 2550 |
| 1103021* | N/A | N/A | 42764 | 42783 | CAGTGTTCAGAAATCTGACT | 87 | 2551 |
| 1103023* | N/A | N/A | 42864 | 42883 | CCTTCTGGCCTTTATGATCT | 69 | 2552 |
| 1103025* | N/A | N/A | 43501 | 43520 | GAGAAATTCCTTTAGCCATT | 16 | 2553 |
| 1103026* | N/A | N/A | 43502 | 43521 | AGAGAAATTCCTTTAGCCAT | 28 | 2554 |
| 1103027* | N/A | N/A | 43503 | 43522 | TAGAGAAATTCCTTTAGCCA | 19 | 2555 |
| 1103028* | N/A | N/A | 43504 | 43523 | TTAGAGAAATTCCTTTAGCC | 30 | 2556 |
| 1103029* | N/A | N/A | 43537 | 43556 | CCAAAATTACTTCTTTTATC | 46 | 2557 |
| 1103030* | N/A | N/A | 43539 | 43558 | TTCCAAAATTACTTCTTTTA | 67 | 2558 |
| 1103031* | N/A | N/A | 43540 | 43559 | GTTCCAAAATTACTTCTTTT | 15 | 2559 |
| 1103032* | N/A | N/A | 43541 | 43560 | TGTTCCAAAATTACTTCTTT | 43 | 2560 |
| 1103033* | N/A | N/A | 43542 | 43561 | ATGTTCCAAAATTACTTCTT | 95 | 2561 |
| 1103034* | N/A | N/A | 43545 | 43564 | CTGATGTTCCAAAATTACTT | 52 | 2562 |
| 1103035* | N/A | N/A | 43576 | 43595 | TTTTACTCTTTTTATTGTTC | 37 | 2563 |
| 1103036* | N/A | N/A | 43582 | 43601 | CCCATATTTTACTCTTTTTA | 30 | 2564 |
| 1103037* | N/A | N/A | 43584 | 43603 | TACCCATATTTTACTCTTTT | 50 | 2565 |
| 1103038* | N/A | N/A | 43620 | 43639 | TAGAAAATTCAAAAGGAGGG | 90 | 2566 |
| 1103039* | N/A | N/A | 43632 | 43651 | CATCATACAATTTAGAAAAT | 112 | 2567 |
| 1103040* | N/A | N/A | 43642 | 43661 | TTGCTTCAACCATCATACAA | 56 | 2568 |
| 1103041* | N/A | N/A | 43651 | 43670 | CTATAATTCTTGCTTCAACC | 19 | 2569 |
| 1103042* | N/A | N/A | 43670 | 43689 | ACTGAAAACCAAATCAGTGC | 91 | 2570 |
| 1103043* | N/A | N/A | 43672 | 43691 | ATACTGAAAACCAAATCAGT | 98 | 2571 |
| 1103044* | N/A | N/A | 43675 | 43694 | TATATACTGAAAACCAAATC | 156 | 2572 |
| 1103045* | N/A | N/A | 43693 | 43712 | CCTTAAATATTTCCAATATA | 73 | 2573 |
| 1103046* | N/A | N/A | 43699 | 43718 | ATAATGCCTTAAATATTTCC | 33 | 2574 |
| 1103047* | N/A | N/A | 43734 | 43753 | CCCTTTATATCCTTTGACCC | 46 | 2575 |
| 1103048* | N/A | N/A | 43741 | 43760 | GTTACCTCCCTTTATATCCT | 32 | 2576 |
| 1103049* | N/A | N/A | 43744 | 43763 | AAGGTTACCTCCCTTTATAT | 69 | 2577 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103050* | N/A | N/A | 43746 | 43765 | GAAAGGTTACCTCCCTTTAT | 82 | 2578 |
| 1103051* | N/A | N/A | 43747 | 43766 | AGAAAGGTTACCTCCCTTTA | 73 | 2579 |
| 1103052* | N/A | N/A | 43755 | 43774 | AGAAATATAGAAAGGTTACC | 93 | 2580 |
| 1103053* | N/A | N/A | 43768 | 43787 | GCATCAGTACAAAAGAAATA | 86 | 2581 |
| 1103054* | N/A | N/A | 43795 | 43814 | ATAGTGAAATTATTTTCCAA | 53 | 2582 |
| 1103055* | N/A | N/A | 43807 | 43826 | GTTTTTAAACAAATAGTGAA | 95 | 2583 |
| 1103056* | N/A | N/A | 43811 | 43830 | TTCAGTTTTTAAACAAATAG | 91 | 2584 |
| 1103057* | N/A | N/A | 43812 | 43831 | GTTCAGTTTTTAAACAAATA | 48 | 2585 |
| 1103059* | N/A | N/A | 44052 | 44071 | TTCAGCAATTAAAGACTTTT | 48 | 2586 |
| 1103061* | N/A | N/A | 44073 | 44092 | CAAATATTAGCCAAAGAGGC | 90 | 2587 |
| 1103062* | N/A | N/A | 44396 | 44415 | ATAATGATCTTCCAGGCTGG | 138 | 2588 |
| 1103063* | N/A | N/A | 44400 | 44419 | CTAAATAATGATCTTCCAGG | 105 | 2589 |
| 1103064* | N/A | N/A | 44404 | 44423 | AGGACTAAATAATGATCTTC | 45 | 2590 |
| 1103065* | N/A | N/A | 44548 | 44567 | ATATAAATTTCTATTTTTGG | 81 | 2591 |
| 1103066* | N/A | N/A | 44549 | 44568 | AATATAAATTTCTATTTTTG | 112 | 2592 |
| 1103067* | N/A | N/A | 44674 | 44693 | CAGTAGAGTATTACATGCTA | 29 | 2593 |
| 1103068* | N/A | N/A | 44688 | 44707 | CTTTTTAATCCTGACAGTAG | 63 | 2594 |
| 1103069* | N/A | N/A | 44693 | 44712 | GGTTTCTTTTTAATCCTGAC | 89 | 2595 |
| 1103070* | N/A | N/A | 44695 | 44714 | TGGGTTTCTTTTTAATCCTG | 76 | 2596 |
| 1103071* | N/A | N/A | 44733 | 44752 | CCCCTGAGATCCAGCCACGG | 90 | 2597 |
| 1103072* | N/A | N/A | 44809 | 44828 | AGCTGTCATTTTTAGTTGAA | 31 | 2598 |
| 1103073* | N/A | N/A | 44826 | 44845 | GTTCTCTATCTCTATACAGC | 19 | 2599 |
| 1103074* | N/A | N/A | 44844 | 44863 | AGTGGAAACCACTAATATGT | 79 | 2600 |
| 1103075* | N/A | N/A | 44861 | 44880 | ACCCACTTTCTCTAACTAGT | 69 | 2601 |
| 1103076* | N/A | N/A | 44897 | 44916 | CTGCTATCGATTTATATTCC | 99 | 2602 |
| 1103077* | N/A | N/A | 44920 | 44939 | GTTATAATACCACAAAGATC | 26 | 2603 |
| 1103078* | N/A | N/A | 44921 | 44940 | TGTTATAATACCACAAAGAT | 80 | 2604 |
| 1103079* | N/A | N/A | 44923 | 44942 | AGTGTTATAATACCACAAAG | 52 | 2605 |
| 1103080* | N/A | N/A | 44924 | 44943 | AAGTGTTATAATACCACAAA | 76 | 2606 |
| 1103081* | N/A | N/A | 44925 | 44944 | GAAGTGTTATAATACCACAA | 33 | 2607 |
| 1103082* | N/A | N/A | 44932 | 44951 | AGACATAGAAGTGTTATAAT | 61 | 2608 |
| 1103083* | N/A | N/A | 44940 | 44959 | TACAATCAAGACATAGAAGT | 76 | 2609 |
| 1103084* | N/A | N/A | 44984 | 45003 | TACATGGCATTTTATCACAC | 32 | 2610 |
| 1103085* | N/A | N/A | 44997 | 45016 | TTATATGTAGTTCTACATGG | 62 | 2611 |
| 1103086* | N/A | N/A | 45032 | 45051 | CAAACTAAAACCTAGATATT | 90 | 2612 |
| 1103087* | N/A | N/A | 45035 | 45054 | GATCAAACTAAAACCTAGAT | 76 | 2613 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103088* | N/A | N/A | 45036 | 45055 | AGATCAAACTAAAACCTAGA | 91 | 2614 |
| 1103089* | N/A | N/A | 45038 | 45057 | AAAGATCAAACTAAAACCTA | 74 | 2615 |
| 1103090* | N/A | N/A | 45041 | 45060 | ACTAAAGATCAAACTAAAAC | 101 | 2616 |
| 1103091* | N/A | N/A | 45043 | 45062 | TAACTAAAGATCAAACTAAA | 113 | 2617 |
| 1103092* | N/A | N/A | 45044 | 45063 | GTAACTAAAGATCAAACTAA | 100 | 2618 |
| 1103093* | N/A | N/A | 45077 | 45096 | TTTGCCCAATTTCACCCAAT | 46 | 2619 |
| 1103095* | N/A | N/A | 45114 | 45133 | AGTTGTAAAGATATTTAAGA | 86 | 2620 |
| 1103097* | N/A | N/A | 45155 | 45174 | AAACCCAACTTTCTATTTTG | 57 | 2621 |
| 1103098* | N/A | N/A | 45161 | 45180 | TTACAAAAACCCAACTTTCT | 86 | 2622 |
| 1103099* | N/A | N/A | 45162 | 45181 | TTTACAAAAACCCAACTTTC | 79 | 2623 |
| 1103100* | N/A | N/A | 45165 | 45184 | GTATTTACAAAAACCCAACT | 45 | 2624 |
| 1103101* | N/A | N/A | 45167 | 45186 | ATGTATTTACAAAAACCCAA | 57 | 2625 |
| 1103102* | N/A | N/A | 45172 | 45191 | AATTCATGTATTTACAAAAA | 76 | 2626 |
| 1103103* | N/A | N/A | 45184 | 45203 | GTGTATATCAACAATTCATG | 8 | 2627 |
| 1103104* | N/A | N/A | 45186 | 45205 | TTGTGTATATCAACAATTCA | 65 | 2628 |
| 1103105* | N/A | N/A | 45313 | 45332 | GATAGCCACCAGTATATTCT | 75 | 2629 |
| 1103106* | N/A | N/A | 45316 | 45335 | CCAGATAGCCACCAGTATAT | 41 | 2630 |
| 1103107* | N/A | N/A | 45332 | 45351 | TCCCCATTTCCTAATCCCAG | 96 | 2631 |
| 1103108* | N/A | N/A | 45370 | 45389 | CCCCAGAAAATTCCCCCATG | 85 | 2632 |
| 1103109* | N/A | N/A | 45390 | 45409 | GATACACAACCATTCCATTG | 68 | 2633 |
| 1103110* | N/A | N/A | 45395 | 45414 | ATCAAGATACACAACCATTC | 63 | 2634 |
| 1103111* | N/A | N/A | 45410 | 45429 | TTTGACAAATACACCATCAA | 68 | 2635 |
| 1103112* | N/A | N/A | 45421 | 45440 | GTTCTATATATTTTGACAAA | 47 | 2636 |
| 1103113* | N/A | N/A | 45423 | 45442 | TAGTTCTATATATTTTGACA | 38 | 2637 |
| 1103114* | N/A | N/A | 45426 | 45445 | TTATAGTTCTATATATTTTG | 73 | 2638 |
| 1103115* | N/A | N/A | 45430 | 45449 | ACTTTTATAGTTCTATATAT | 104 | 2639 |
| 1103116* | N/A | N/A | 45473 | 45492 | CACGAGTTTCTTTTTTTGAT | 20 | 2640 |
| 1103117* | N/A | N/A | 45491 | 45510 | AATGTATTTCTATTTGAGCA | 40 | 2641 |
| 1103118* | N/A | N/A | 45520 | 45539 | CAAAGTCATCAAAAGGCAAG | 86 | 2642 |
| 1103119* | N/A | N/A | 45525 | 45544 | ATTCTCAAAGTCATCAAAAG | 84 | 2643 |
| 1103120* | N/A | N/A | 45529 | 45548 | GAAAATTCTCAAAGTCATCA | 99 | 2644 |
| 1103121* | N/A | N/A | 45534 | 45553 | TTCCAGAAAATTCTCAAAGT | 95 | 2645 |
| 1103122* | N/A | N/A | 45548 | 45567 | CATTTCTTTAAAATTTCCAG | 92 | 2646 |
| 1103123* | N/A | N/A | 45552 | 45571 | ACCACATTTCTTTAAAATTT | 88 | 2647 |
| 1103124* | N/A | N/A | 45559 | 45578 | AAACAAAACCACATTTCTTT | 102 | 2648 |
| 1103125* | N/A | N/A | 45560 | 45579 | GAAACAAAACCACATTTCTT | 100 | 2649 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103126* | N/A | N/A | 45561 | 45580 | GGAAACAAAACCACATTTCT | 108 | 2650 |
| 1103127* | N/A | N/A | 45562 | 45581 | GGGAAACAAAACCACATTTC | 80 | 2651 |
| 1103128* | N/A | N/A | 45564 | 45583 | TTGGGAAACAAAACCACATT | 100 | 2652 |
| 1103129* | N/A | N/A | 45565 | 45584 | GTTGGGAAACAAAACCACAT | 94 | 2653 |

TABLE 3

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100368 | 312 | 331 | 16178 | 16197 | CCCAAACTTTCAAGGCATTG | 31 | 169 |
| 1100368 | 312 | 331 | 16178 | 16197 | CCCAAACTTTCAAGGCATTG | 30 | 169 |
| 1100404 | 407 | 426 | 16700 | 16719 | GTGTTCCTTATAATTGCATA | 32 | 203 |
| 1100404 | 407 | 426 | 16700 | 16719 | GTGTTCCTTATAATTGCATA | 31 | 203 |
| 1100440 | 515 | 534 | 21242 | 21261 | TAATTGAGCCAAGAAAAGTG | 96 | 237 |
| 1100440 | 515 | 534 | 21242 | 21261 | TAATTGAGCCAAGAAAAGTG | 130 | 237 |
| 1100476 | 711 | 730 | 27568 | 27587 | TTCCTGAGCCATCATTTGCT | 62 | 271 |
| 1100476 | 711 | 730 | 27568 | 27587 | TTCCTGAGCCATCATTTGCT | 71 | 271 |
| 1100512 | 886 | 905 | 28981 | 29000 | TCTGAAGTAAGATTTGTACC | 57 | 305 |
| 1100512 | 886 | 905 | 28981 | 29000 | TCTGAAGTAAGATTTGTACC | 95 | 305 |
| 1100548 | 1103 | 1122 | 45629 | 45648 | GACAGTTTCTAAAGACATGG | 62 | 2455 |
| 1100584 | 1244 | 1263 | 45770 | 45789 | AAGTCTTATTTCCTCATCTC | 18 | 338 |
| 1100584 | 1244 | 1263 | 45770 | 45789 | AAGTCTTATTTCCTCATCTC | 16 | 338 |
| 1100620 | 1619 | 1638 | 46145 | 46164 | GAACCATTACTATTATCAAC | 31 | 372 |
| 1100620 | 1619 | 1638 | 46145 | 46164 | GAACCATTACTATTATCAAC | 35 | 372 |
| 1100656 | 1807 | 1826 | 46333 | 46352 | AGTCATGAAATAATGATCCC | 76 | 406 |
| 1100656 | 1807 | 1826 | 46333 | 46352 | AGTCATGAAATAATGATCCC | 59 | 406 |
| 1100692 | 2047 | 2066 | 46573 | 46592 | TAGTCTTCTAACAGAAGGAG | 81 | 440 |
| 1100728 | 2236 | 2255 | 46762 | 46781 | TCATGTTCCAGATCACCATC | 38 | 474 |
| 1100728 | 2236 | 2255 | 46762 | 46781 | TCATGTTCCAGATCACCATC | 34 | 474 |
| 1100764 | 2386 | 2405 | 46912 | 46931 | AATTAAAGAGAATATTTATC | 95 | 508 |
| 1100764 | 2386 | 2405 | 46912 | 46931 | AATTAAAGAGAATATTTATC | 96 | 508 |
| 1100800 | 2570 | 2589 | 47096 | 47115 | GAAGTTGTCAGCTGAAATTT | 35 | 542 |
| 1100800 | 2570 | 2589 | 47096 | 47115 | GAAGTTGTCAGCTGAAATTT | 38 | 542 |
| 1100836 | 2744 | 2763 | 47270 | 47289 | AATGACTTAAAAAATCTGTT | 84 | 576 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100836 | 2744 | 2763 | 47270 | 47289 | AATGACTTAAAAAATCTGTT | 85 | 576 |
| 1100872 | 2927 | 2946 | 47453 | 47472 | CAGTCTTAAAATATTTAGCT | 19 | 610 |
| 1100872 | 2927 | 2946 | 47453 | 47472 | CAGTCTTAAAATATTTAGCT | 14 | 610 |
| 1100908 | 3062 | 3081 | 47588 | 47607 | TCTCATTTTTATATTAGGTA | 31 | 644 |
| 1100908 | 3062 | 3081 | 47588 | 47607 | TCTCATTTTTATATTAGGTA | 20 | 644 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 9 | 45 |
| 1100945 | 3555 | 3574 | 48081 | 48100 | TCACAACAAACTACACAAAC | 77 | 678 |
| 1100945 | 3555 | 3574 | 48081 | 48100 | TCACAACAAACTACACAAAC | 70 | 678 |
| 1100981 | 3682 | 3701 | 48208 | 48227 | CTGGCATCTTTTCATACTGG | 37 | 712 |
| 1100981 | 3682 | 3701 | 48208 | 48227 | CTGGCATCTTTTCATACTGG | 33 | 712 |
| 1101017 | 3874 | 3893 | 48400 | 48419 | TATTAAACATTAAGATGTTC | 78 | 746 |
| 1101017 | 3874 | 3893 | 48400 | 48419 | TATTAAACATTAAGATGTTC | 88 | 746 |
| 1101053 | 3935 | 3954 | 48461 | 48480 | GTACATACTTGATCCCAGTA | 20 | 780 |
| 1101053 | 3935 | 3954 | 48461 | 48480 | GTACATACTTGATCCCAGTA | 16 | 780 |
| 1101089 | 4022 | 4041 | 48548 | 48567 | AAAACATAAATTACTCATTA | 102 | 814 |
| 1101089 | 4022 | 4041 | 48548 | 48567 | AAAACATAAATTACTCATTA | 100 | 814 |
| 1101125 | 4170 | 4189 | 48696 | 48715 | AATTGTAAATTATTTGGCCA | 78 | 848 |
| 1101125 | 4170 | 4189 | 48696 | 48715 | AATTGTAAATTATTTGGCCA | 62 | 848 |
| 1101161 | 4834 | 4853 | 49360 | 49379 | CTACTTAAGATTTTAAAATT | 96 | 882 |
| 1101161 | 4834 | 4853 | 49360 | 49379 | CTACTTAAGATTTTAAAATT | 137 | 882 |
| 1101197 | 5992 | 6011 | 50518 | 50537 | TAATTAGGGTCACATATATA | 70 | 916 |
| 1101197 | 5992 | 6011 | 50518 | 50537 | TAATTAGGGTCACATATATA | 113 | 916 |
| 1101233 | 6228 | 6247 | 50754 | 50773 | ATCAAAATTCTAGAATTTAC | 92 | 950 |
| 1101233 | 6228 | 6247 | 50754 | 50773 | ATCAAAATTCTAGAATTTAC | 72 | 950 |
| 1101269 | 6563 | 6582 | 51089 | 51108 | CAGTGTTGTAAAAATTAGAT | 81 | 984 |
| 1101269 | 6563 | 6582 | 51089 | 51108 | CAGTGTTGTAAAAATTAGAT | 78 | 984 |
| 1101305 | 6764 | 6783 | 51290 | 51309 | GTGTGTGTAATAACAGCAAA | 75 | 1018 |
| 1101305 | 6764 | 6783 | 51290 | 51309 | GTGTGTGTAATAACAGCAAA | 89 | 1018 |
| 1101341 | 96 | 115 | 13165 | 13184 | GAGCACAAAGTGAGCCTTCT | 60 | 1052 |
| 1101341 | 96 | 115 | 13165 | 13184 | GAGCACAAAGTGAGCCTTCT | 91 | 1052 |
| 1101377 | 229 | 248 | 13298 | 13317 | GTGCGATAATCTTCACTAGT | 82 | 1086 |
| 1101377 | 229 | 248 | 13298 | 13317 | GTGCGATAATCTTCACTAGT | 85 | 1086 |
| 1101413 | N/A | N/A | 51449 | 51468 | ACACAAATTCAAAAGGAAAT | 91 | 1116 |
| 1101413 | N/A | N/A | 51449 | 51468 | ACACAAATTCAAAAGGAAAT | 85 | 1116 |
| 1101593 | N/A | N/A | 4174 | 4193 | CACTCCTAATACCTAAAAAC | 97 | 1166 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101593 | N/A | N/A | 4174 | 4193 | CACTCCTAATACCTAAAAAC | 119 | 1166 |
| 1101629 | N/A | N/A | 5365 | 5384 | GCCTTTGAAAATTAATAACA | 89 | 1200 |
| 1101629 | N/A | N/A | 5365 | 5384 | GCCTTTGAAAATTAATAACA | 86 | 1200 |
| 1101665 | N/A | N/A | 6667 | 6686 | TGACAGAGACTACAGCTGGC | 91 | 1234 |
| 1101665 | N/A | N/A | 6667 | 6686 | TGACAGAGACTACAGCTGGC | 76 | 1234 |
| 1101701 | N/A | N/A | 7486 | 7505 | ACACTACTAACTACAACACA | 87 | 1268 |
| 1101701 | N/A | N/A | 7486 | 7505 | ACACTACTAACTACAACACA | 117 | 1268 |
| 1101737 | N/A | N/A | 8823 | 8842 | TCAGTACAAATTTAAAAATC | 84 | 1302 |
| 1101737 | N/A | N/A | 8823 | 8842 | TCAGTACAAATTTAAAAATC | 102 | 1302 |
| 1101773 | N/A | N/A | 9341 | 9360 | TTCCAGTCACAAAAGCTCAA | 59 | 1336 |
| 1101773 | N/A | N/A | 9341 | 9360 | TTCCAGTCACAAAAGCTCAA | 57 | 1336 |
| 1101809 | N/A | N/A | 10463 | 10482 | TACTGAATAATATGCAAATT | 107 | 1370 |
| 1101809 | N/A | N/A | 10463 | 10482 | TACTGAATAATATGCAAATT | 98 | 1370 |
| 1101845 | N/A | N/A | 11711 | 11730 | CCCTAGAACATTTATTCTTT | 84 | 1404 |
| 1101845 | N/A | N/A | 11711 | 11730 | CCCTAGAACATTTATTCTTT | 86 | 1404 |
| 1101881 | N/A | N/A | 13129 | 13148 | AGAAAAAATTAAAATGTGAC | 80 | 1438 |
| 1101881 | N/A | N/A | 13129 | 13148 | AGAAAAAATTAAAATGTGAC | 105 | 1438 |
| 1101917 | N/A | N/A | 14390 | 14409 | AAGGAATTTTTAAATGCCCC | 70 | 1472 |
| 1101917 | N/A | N/A | 14390 | 14409 | AAGGAATTTTTAAATGCCCC | 72 | 1472 |
| 1101953 | N/A | N/A | 15441 | 15460 | CTGGGCATTTAAACTGAAGG | 59 | 1506 |
| 1101953 | N/A | N/A | 15441 | 15460 | CTGGGCATTTAAACTGAAGG | 46 | 1506 |
| 1101989 | N/A | N/A | 16110 | 16129 | CCATTCCAAATTTAGGAAGT | 92 | 1540 |
| 1101989 | N/A | N/A | 16110 | 16129 | CCATTCCAAATTTAGGAAGT | 73 | 1540 |
| 1102025 | N/A | N/A | 17173 | 17192 | TTCCTAATTTTAAAGTCAGC | 33 | 1574 |
| 1102025 | N/A | N/A | 17173 | 17192 | TTCCTAATTTTAAAGTCAGC | 43 | 1574 |
| 1102061 | N/A | N/A | 17584 | 17603 | CTTGCTCAAGACATATTTCA | 60 | 1608 |
| 1102061 | N/A | N/A | 17584 | 17603 | CTTGCTCAAGACATATTTCA | 52 | 1608 |
| 1102097 | N/A | N/A | 19126 | 19145 | CCAGAGGTTAAATAATCTCA | 56 | 1642 |
| 1102097 | N/A | N/A | 19126 | 19145 | CCAGAGGTTAAATAATCTCA | 47 | 1642 |
| 1102133 | N/A | N/A | 19460 | 19479 | ACAATGTTAATACTTTTTCC | 50 | 1676 |
| 1102133 | N/A | N/A | 19460 | 19479 | ACAATGTTAATACTTTTTCC | 63 | 1676 |
| 1102169 | N/A | N/A | 20122 | 20141 | TGTCAAAAGATTCCAATTGT | 65 | 1710 |
| 1102169 | N/A | N/A | 20122 | 20141 | TGTCAAAAGATTCCAATTGT | 62 | 1710 |
| 1102205 | N/A | N/A | 21101 | 21120 | TTAAGAATAGATACAACCCA | 80 | 1744 |
| 1102205 | N/A | N/A | 21101 | 21120 | TTAAGAATAGATACAACCCA | 89 | 1744 |
| 1102241 | N/A | N/A | 22464 | 22483 | TTTATGTTATTTTTAGCCA | 86 | 1778 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102241 | N/A | N/A | 22464 | 22483 | TTTATGTTATTTTTTAGCCA | 77 | 1778 |
| 1102277 | N/A | N/A | 23289 | 23308 | AGAGACAATCCTAAGGAAAA | 83 | 1812 |
| 1102277 | N/A | N/A | 23289 | 23308 | AGAGACAATCCTAAGGAAAA | 90 | 1812 |
| 1102313 | N/A | N/A | 24093 | 24112 | TTAGGAAAACCACAGCATGG | 84 | 1846 |
| 1102313 | N/A | N/A | 24093 | 24112 | TTAGGAAAACCACAGCATGG | 78 | 1846 |
| 1102349 | N/A | N/A | 25507 | 25526 | CCAGAAATCCAGGGTTTCCC | 62 | 1880 |
| 1102349 | N/A | N/A | 25507 | 25526 | CCAGAAATCCAGGGTTTCCC | 92 | 1880 |
| 1102385 | N/A | N/A | 26322 | 26341 | TCTTGGTTTCTACTGTTAAA | 21 | 1914 |
| 1102385 | N/A | N/A | 26322 | 26341 | TCTTGGTTTCTACTGTTAAA | 22 | 1914 |
| 1102421 | N/A | N/A | 27036 | 27055 | TAATATATTTAAGTATTTCA | 77 | 1948 |
| 1102421 | N/A | N/A | 27036 | 27055 | TAATATATTTAAGTATTTCA | 115 | 1948 |
| 1102457 | N/A | N/A | 27887 | 27906 | AAAAATATAACTACTCCTAA | 83 | 1982 |
| 1102457 | N/A | N/A | 27887 | 27906 | AAAAATATAACTACTCCTAA | 59 | 1982 |
| 1102493 | N/A | N/A | 28293 | 28312 | AAATAATTTCATTAGAAAGT | 89 | 2016 |
| 1102493 | N/A | N/A | 28293 | 28312 | AAATAATTTCATTAGAAAGT | 80 | 2016 |
| 1102529 | N/A | N/A | 29028 | 29047 | AACTACTTTACTTTTCAAAG | 81 | 2050 |
| 1102529 | N/A | N/A | 29028 | 29047 | AACTACTTTACTTTTCAAAG | 104 | 2050 |
| 1102565 | N/A | N/A | 30354 | 30373 | AGAATGGATGAAATACAGCA | 53 | 2084 |
| 1102565 | N/A | N/A | 30354 | 30373 | AGAATGGATGAAATACAGCA | 81 | 2084 |
| 1102601 | N/A | N/A | 30610 | 30629 | TTAGCCATTAATCTATACTG | 34 | 2118 |
| 1102601 | N/A | N/A | 30610 | 30629 | TTAGCCATTAATCTATACTG | 32 | 2118 |
| 1102637 | N/A | N/A | 32676 | 32695 | GCCAAAATACTAACATCAGT | 25 | 2152 |
| 1102637 | N/A | N/A | 32676 | 32695 | GCCAAAATACTAACATCAGT | 33 | 2152 |
| 1102673 | N/A | N/A | 33921 | 33940 | TGTTTACTAAAAAGCACTAG | 65 | 2186 |
| 1102673 | N/A | N/A | 33921 | 33940 | TGTTTACTAAAAAGCACTAG | 98 | 2186 |
| 1102709 | N/A | N/A | 34405 | 34424 | CTTCAAATACTCAAAAAGGG | 63 | 2220 |
| 1102709 | N/A | N/A | 34405 | 34424 | CTTCAAATACTCAAAAAGGG | 63 | 2220 |
| 1102745 | N/A | N/A | 34877 | 34896 | GGCTTGAAAATATTATTTAA | 83 | 2254 |
| 1102745 | N/A | N/A | 34877 | 34896 | GGCTTGAAAATATTATTTAA | 89 | 2254 |
| 1102781 | N/A | N/A | 35566 | 35585 | TGCCAGTCCCAAAATTCTGC | 83 | 2288 |
| 1102781 | N/A | N/A | 35566 | 35585 | TGCCAGTCCCAAAATTCTGC | 95 | 2288 |
| 1102817 | N/A | N/A | 37177 | 37196 | TACCAGCAACAATTATTAAT | 67 | 2322 |
| 1102817 | N/A | N/A | 37177 | 37196 | TACCAGCAACAATTATTAAT | 68 | 2322 |
| 1102853 | N/A | N/A | 37900 | 37919 | ATCAGATTTTAAGTAATACT | 66 | 2356 |
| 1102853 | N/A | N/A | 37900 | 37919 | ATCAGATTTTAAGTAATACT | 94 | 2356 |
| 1102889 | N/A | N/A | 38368 | 38387 | AAAACCTATCATACAAAAAG | 95 | 2390 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102889 | N/A | N/A | 38368 | 38387 | AAAACCTATCATACAAAAAG | 108 | 2390 |
| 1102925 | N/A | N/A | 38886 | 38905 | AAAAGAATAAATACACCATG | 84 | 2424 |
| 1102925 | N/A | N/A | 38886 | 38905 | AAAAGAATAAATACACCATG | 102 | 2424 |
| 1102961 | N/A | N/A | 39753 | 39772 | CTCAAGTATTTTTCATTTTC | 45 | 2493 |
| 1102997 | N/A | N/A | 40957 | 40976 | AAGGTCTACATTTAGGCAGT | 38 | 2527 |
| 1103033 | N/A | N/A | 43542 | 43561 | ATGTTCCAAAATTACTTCTT | 52 | 2561 |
| 1103069 | N/A | N/A | 44693 | 44712 | GGTTTCTTTTTAATCCTGAC | 13 | 2595 |
| 1103105 | N/A | N/A | 45313 | 45332 | GATAGCCACCAGTATATTCT | 32 | 2629 |
| 1100548* | 1103 | 1122 | 45629 | 45648 | GACAGTTTCTAAAGACATGG | 47 | 2455 |
| 1100692* | 2047 | 2066 | 46573 | 46592 | TAGTCTTCTAACAGAAGGAG | 58 | 440 |
| 1102961* | N/A | N/A | 39753 | 39772 | CTCAAGTATTTTTCATTTTC | 46 | 2493 |
| 1102997* | N/A | N/A | 40957 | 40976 | AAGGTCTACATTTAGGCAGT | 34 | 2527 |
| 1103033* | N/A | N/A | 43542 | 43561 | ATGTTCCAAAATTACTTCTT | 50 | 2561 |
| 1103069* | N/A | N/A | 44693 | 44712 | GGTTTCTTTTTAATCCTGAC | 14 | 2595 |
| 1103105* | N/A | N/A | 45313 | 45332 | GATAGCCACCAGTATATTCT | 35 | 2629 |

TABLE 4

Percent control of human ATXN3 RNA with 5-10-5 MOE gapmers with mixed internucleoside linkages

| Compound Number | SEQ ID No: 3 Start Site | SEQ ID No: 3 Stop Site | Sequence (5' to 3') | ATXN3 (% control) | SEQ ID NO |
|---|---|---|---|---|---|
| 1100366 | 88 | 107 | GCATTGCTTATAACTTTCTC | 63 | 2654 |
| 1100367 | 89 | 108 | GGCATTGCTTATAACTTTCT | 49 | 2655 |

TABLE 5

Percent control of human ATXN3 RNA with 5-10-5 MOE gapmers with mixed internucleoside linkages

| Compound Number | SEQ ID No: 4 Start Site | SEQ ID No: 4 Stop Site | Sequence (5' to 3') | ATXN3 (% control) | SEQ ID NO |
|---|---|---|---|---|---|
| 1101399 | 291 | 310 | TAAACCACTGAATAGAGAAA | 91 | 2656 |
| 1101400 | 294 | 313 | AGTTAAACCACTGAATAGAG | 76 | 2657 |
| 1101401 | 295 | 314 | AAGTTAAACCACTGAATAGA | 107 | 2658 |

TABLE 5-continued

Percent control of human ATXN3 RNA with 5-10-5 MOE gapmers with mixed internucleoside linkages

| Compound Number | SEQ ID No: 4 Start Site | SEQ ID No: 4 Stop Site | Sequence (5' to 3') | ATXN3 (% control) | SEQ ID NO |
|---|---|---|---|---|---|
| 1101402 | 297 | 316 | TCAAGTTAAACCACTGAATA | 65 | 2659 |
| 1101403 | 298 | 317 | TTCAAGTTAAACCACTGAAT | 90 | 2660 |
| 1101404 | 300 | 319 | AATTCAAGTTAAACCACTGA | 89 | 2661 |

TABLE 6

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% control) | SEQ ID NO |
|---|---|---|---|---|---|
| 1101448 | 9782 | 9801 | CAAAGCAGTTAAATCTGGCC | 96 | 2662 |
| 1101449 | 10192 | 10211 | TGGGTTTATATATTTTTCTT | 72 | 2663 |
| 1101449 | 10192 | 10211 | TGGGTTTATATATTTTTCTT | 100 | 2663 |
| 1101449 | 10192 | 10211 | TGGGTTTATATATTTTTCTT | 111 | 2663 |
| 1101450 | 10194 | 10213 | TGTGGGTTTATATATTTTTC | 78 | 2664 |
| 1101451 | 10235 | 10254 | TAATCCAATGAATGCATCTC | 79 | 2665 |
| 1101452 | 10588 | 10607 | AAGTCACTGTTATATTAGTT | 201 | 2666 |
| 1101453 | 10595 | 10614 | GCATGTAAAGTCACTGTTAT | 121 | 2667 |
| 1101454 | 10609 | 10628 | AAAAAAAACCCATAGCATGT | 109 | 2668 |
| 1101455 | 10610 | 10629 | GAAAAAAAACCCATAGCATG | 89 | 2669 |
| 1101456 | 10611 | 10630 | AGAAAAAAAACCCATAGCAT | 81 | 2670 |
| 1101457 | 10615 | 10634 | GAGGAGAAAAAAAACCCATA | 95 | 2671 |
| 1101458 | 10630 | 10649 | ATTTCTTGAAGATGAGAGGA | 99 | 2672 |
| 1101459 | 10683 | 10702 | AGCAGATTCCTGACACTGTG | 110 | 2673 |
| 1101460 | 10684 | 10703 | GAGCAGATTCCTGACACTGT | 118 | 2674 |
| 1101461 | 10697 | 10716 | AATTATACAGAAAGAGCAGA | 84 | 2675 |
| 1101462 | 10699 | 10718 | ACAATTATACAGAAAGAGCA | 127 | 2676 |
| 1101463 | 10701 | 10720 | TAACAATTATACAGAAAGAG | 95 | 2677 |
| 1101464 | 10702 | 10721 | GTAACAATTATACAGAAAGA | 99 | 2678 |
| 1101465 | 10703 | 10722 | TGTAACAATTATACAGAAAG | 109 | 2679 |
| 1101466 | 10704 | 10723 | CTGTAACAATTATACAGAAA | 124 | 2680 |
| 1101467 | 10705 | 10724 | CCTGTAACAATTATACAGAA | 71 | 2681 |
| 1101468 | 10706 | 10725 | TCCTGTAACAATTATACAGA | 90 | 2682 |
| 1101469 | 11124 | 11143 | AGGATGAGATACAAGGTCAA | 108 | 2683 |

TABLE 6-continued

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% con-trol) | SEQ ID NO |
|---|---|---|---|---|---|
| 1101470 | 11556 | 11575 | ACATAAAGCCATTATGTCAG | 91 | 2684 |
| 1101471 | 11557 | 11576 | TACATAAAGCCATTATGTCA | 96 | 2685 |
| 1101472 | 11558 | 11577 | GTACATAAAGCCATTATGTC | 74 | 2686 |
| 1101473 | 11564 | 11583 | AGCCATGTACATAAAGCCAT | 105 | 2687 |
| 1101474 | 12097 | 12116 | AAAAACCACCTTGTAGCTAG | 107 | 2688 |
| 1101475 | 12100 | 12119 | AATAAAAACCACCTTGTAGC | 86 | 2689 |
| 1101476 | 12101 | 12120 | GAATAAAAACCACCTTGTAG | 79 | 2690 |
| 1101477 | 12102 | 12121 | AGAATAAAAACCACCTTGTA | 77 | 2691 |
| 1101478 | 12103 | 12122 | CAGAATAAAAACCACCTTGT | 77 | 2692 |
| 1101479 | 12105 | 12124 | CCCAGAATAAAAACCACCTT | 72 | 2693 |
| 1101480 | 12106 | 12125 | ACCCAGAATAAAAACCACCT | 89 | 2694 |
| 1101481 | 12113 | 12132 | CATGGCAACCCAGAATAAAA | 88 | 2695 |
| 1101482 | 12114 | 12133 | GCATGGCAACCCAGAATAAA | 94 | 2696 |
| 1101483 | 12502 | 12521 | CTGGAACACTTTTAAAAAAT | 87 | 2697 |
| 1101484 | 12535 | 12554 | TTTCTTACTCCCCTATGCCC | 95 | 2698 |
| 1101485 | 12541 | 12560 | TTCCACTTTCTTACTCCCCT | 87 | 2699 |
| 1101485 | 12541 | 12560 | TTCCACTTTCTTACTCCCCT | 110 | 2699 |
| 1101485 | 12541 | 12560 | TTCCACTTTCTTACTCCCCT | 93 | 2699 |
| 1101486 | 12542 | 12561 | TTTCCACTTTCTTACTCCCC | 79 | 2700 |
| 1101487 | 12626 | 12645 | ATGTGAATATCCTGCCTCCA | 111 | 2701 |
| 1101488 | 12688 | 12707 | ACCTTATTCAGCCAGAGTTG | 92 | 2702 |
| 1101489 | 12691 | 12710 | GCAACCTTATTCAGCCAGAG | 79 | 2703 |
| 1101490 | 12725 | 12744 | GCCCATACTTTCCAGGTGCC | 77 | 2704 |
| 1101491 | 12727 | 12746 | GAGCCCATACTTTCCAGGTG | 102 | 2705 |
| 1101492 | 12732 | 12751 | TACTGGAGCCCATACTTTCC | 98 | 2706 |
| 1101493 | 12785 | 12804 | CCCTTTACCACTTTTGTGCA | 70 | 2707 |
| 1101494 | 12788 | 12807 | CATCCCTTTACCACTTTTGT | 81 | 2708 |
| 1101495 | 12827 | 12846 | CATGACAGCCAAGATGCCAG | 87 | 2709 |
| 1101496 | 12938 | 12957 | TTAGCATTTCTCTTCTGTTG | 78 | 2710 |
| 1101497 | 13356 | 13375 | TGTTGCTTTCCTTTCCTGCA | 97 | 2711 |
| 1101498 | 13395 | 13414 | GATTTCAGTCTACATCTAAC | 111 | 2712 |
| 1101499 | 13399 | 13418 | TCCTGATTTCAGTCTACATC | 88 | 2713 |
| 1101500 | 13402 | 13421 | ACCTCCTGATTTCAGTCTAC | 96 | 2714 |
| 1101501 | 13414 | 13433 | AGTTTTAACCACACCTCCTG | 91 | 2715 |
| 1101502 | 13418 | 13437 | AAAGAGTTTTAACCACACCT | 92 | 2716 |

TABLE 6-continued

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% con-trol) | SEQ ID NO |
|---|---|---|---|---|---|
| 1101503 | 13428 | 13447 | AGCCTCTTTCAAAGAGTTTT | 90 | 2717 |
| 1101504 | 13917 | 13936 | TCTGAAATTAATAATGGTGT | 117 | 2718 |
| 1101505 | 13919 | 13938 | GCTCTGAAATTAATAATGGT | 89 | 2719 |
| 1101506 | 13968 | 13987 | GCCTTGTTTTCTTCCAAGAA | 119 | 2720 |
| 1101507 | 14062 | 14081 | ACAAAACATCAAGAATTCTA | 92 | 2721 |
| 1101508 | 14064 | 14083 | CAACAAAACATCAAGAATTC | 101 | 2722 |
| 1101509 | 14065 | 14084 | TCAACAAAACATCAAGAATT | 125 | 2723 |
| 1101510 | 14066 | 14085 | TTCAACAAAACATCAAGAAT | 86 | 2724 |
| 1101511 | 14069 | 14088 | GTTTTCAACAAAACATCAAG | 143 | 2725 |
| 1101512 | 14070 | 14089 | TGTTTTCAACAAAACATCAA | 86 | 2726 |
| 1101513 | 14074 | 14093 | CTTCTGTTTTCAACAAAACA | 94 | 2727 |
| 1101514 | 14076 | 14095 | TGCTTCTGTTTTCAACAAAA | 90 | 2728 |
| 1101515 | 14111 | 14130 | GAATCTTTCTAAAACTTACC | 62 | 2729 |
| 1101516 | 14112 | 14131 | AGAATCTTTCTAAAACTTAC | 81 | 2730 |
| 1101517 | 14115 | 14134 | TACAGAATCTTTCTAAAACT | 80 | 2731 |
| 1101518 | 14207 | 14226 | GTACCAAGATTATATTGCCT | 90 | 2732 |
| 1101519 | 14208 | 14227 | TGTACCAAGATTATATTGCC | 84 | 2733 |
| 1101520 | 14209 | 14228 | TTGTACCAAGATTATATTGC | 102 | 2734 |
| 1101521 | 14212 | 14231 | ATGTTGTACCAAGATTATAT | 116 | 2735 |
| 1101521 | 14212 | 14231 | ATGTTGTACCAAGATTATAT | 70 | 2735 |
| 1101521 | 14212 | 14231 | ATGTTGTACCAAGATTATAT | 130 | 2735 |
| 1101522 | 14214 | 14233 | AAATGTTGTACCAAGATTAT | 76 | 2736 |
| 1101523 | 14239 | 14258 | AAGTCTTATTCATTGCAGCT | 80 | 2737 |
| 1101524 | 14240 | 14259 | TAAGTCTTATTCATTGCAGC | 95 | 2738 |
| 1101525 | 14430 | 14449 | TCTGAATTTCTAAGCATTAG | 99 | 2739 |
| 1101526 | 14431 | 14450 | TTCTGAATTTCTAAGCATTA | 95 | 2740 |
| 1101527 | 14432 | 14451 | TTTCTGAATTTCTAAGCATT | 98 | 2741 |
| 1101528 | 14456 | 14475 | GACTTTAAAATTTAGTCTGA | 83 | 2742 |
| 1101529 | 14459 | 14478 | GTAGACTTTAAAATTTAGTC | 78 | 2743 |
| 1101530 | 14460 | 14479 | AGTAGACTTTAAAATTTAGT | 92 | 2744 |
| 1101531 | 14461 | 14480 | AAGTAGACTTTAAAATTTAG | 81 | 2745 |
| 1101532 | 14507 | 14526 | TCAAAATGAATTTATTTATG | 91 | 2746 |
| 1101533 | 14509 | 14528 | CATCAAAATGAATTTATTTA | 87 | 2747 |
| 1101534 | 14515 | 14534 | GAAAACCATCAAAATGAATT | 120 | 2748 |
| 1101535 | 14518 | 14537 | TGAGAAAACCATCAAAATGA | 63 | 2749 |

TABLE 6-continued

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% control) | SEQ ID NO |
|---|---|---|---|---|---|
| 1101536 | 14519 | 14538 | CTGAGAAAACCATCAAAATG | 102 | 2750 |
| 1101537 | 14520 | 14539 | TCTGAGAAAACCATCAAAAT | 114 | 2751 |
| 1101538 | 14523 | 14542 | TGTTCTGAGAAAACCATCAA | 150 | 2752 |
| 1101539 | 14850 | 14869 | TTTCCATTACTCAAGCAGTG | 74 | 2753 |
| 1101540 | 15114 | 15133 | AAAGACATACAAGTTTGATA | 127 | 2754 |
| 1101541 | 15119 | 15138 | AGTTAAAAGACATACAAGTT | 83 | 2755 |
| 1101542 | 15120 | 15139 | AAGTTAAAAGACATACAAGT | 104 | 2756 |
| 1101543 | 15189 | 15208 | TGGTGGGTACATAAGGTTCA | 105 | 2757 |
| 1101544 | 15215 | 15234 | AGGAACTGATAATTGTTGAA | 86 | 2758 |
| 1101545 | 15232 | 15251 | GTGAAACAAGAATTGTCAGG | 91 | 2759 |
| 1101546 | 15333 | 15352 | GCTTCAAAATAATGGAAGTT | 107 | 2760 |
| 1101547 | 15334 | 15353 | TGCTTCAAAATAATGGAAGT | 107 | 2761 |
| 1101548 | 15335 | 15354 | GTGCTTCAAAATAATGGAAG | 106 | 2762 |
| 1101549 | 15336 | 15355 | TGTGCTTCAAAATAATGGAA | 90 | 2763 |
| 1101550 | 15337 | 15356 | ATGTGCTTCAAAATAATGGA | 75 | 2764 |
| 1101551 | 15379 | 15398 | CTTAATAAATAATGTGATAA | 94 | 2765 |
| 1101552 | 15381 | 15400 | AACTTAATAAATAATGTGAT | 100 | 2766 |
| 1101553 | 15382 | 15401 | AAACTTAATAAATAATGTGA | 124 | 2767 |
| 1101554 | 15441 | 15460 | CTATGTCCTAAAAGTTTCTC | 77 | 2768 |
| 1101555 | 15442 | 15461 | GCTATGTCCTAAAAGTTTCT | 136 | 2769 |
| 1101556 | 15455 | 15474 | AATTAACATAAAAGCTATGT | 84 | 2770 |
| 1101557 | 15457 | 15476 | GTAATTAACATAAAAGCTAT | 96 | 2771 |
| 1101557 | 15457 | 15476 | GTAATTAACATAAAAGCTAT | 79 | 2771 |
| 1101557 | 15457 | 15476 | GTAATTAACATAAAAGCTAT | 114 | 2771 |
| 1101558 | 15459 | 15478 | AAGTAATTAACATAAAAGCT | 86 | 2772 |
| 1101559 | 15472 | 15491 | TAGTGCAGAAATTAAGTAAT | 98 | 2773 |
| 1101560 | 15479 | 15498 | GGATGGCTAGTGCAGAAATT | 104 | 2774 |
| 1101561 | 15507 | 15526 | CTAGTGCAGAAAATTAGAAG | 96 | 2775 |
| 1101562 | 15513 | 15532 | GGATAGCTAGTGCAGAAAAT | 88 | 2776 |
| 1101563 | 15619 | 15638 | AGAATGAGACATGTAAGTAT | 107 | 2777 |
| 1101564 | 15627 | 15646 | GGTGAAAAAGAATGAGACAT | 69 | 2778 |
| 1101565 | 15631 | 15650 | CCTGGGTGAAAAAGAATGAG | 70 | 2779 |
| 1101566 | 15633 | 15652 | CACCTGGGTGAAAAAGAATG | 106 | 2780 |
| 1101567 | 16440 | 16459 | AACAAAAATTATCTAGATCC | 94 | 2781 |
| 1101568 | 16913 | 16932 | GTTGAGTTTTTATATTTGAT | 69 | 2782 |

TABLE 6-continued

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% control) | SEQ ID NO |
|---|---|---|---|---|---|
| 1101569 | 16915 | 16934 | GGGTTGAGTTTTTATATTTG | 90 | 2783 |
| 1101570 | 19195 | 19214 | AAGATACTACTATAGCATAG | 88 | 2784 |
| 1101571 | 19196 | 19215 | GAAGATACTACTATAGCATA | 78 | 2785 |
| 1101572 | 19197 | 19216 | GGAAGATACTACTATAGCAT | 107 | 2786 |
| 1101573 | 19198 | 19217 | TGGAAGATACTACTATAGCA | 84 | 2787 |

Example 2: Effect of 5-10-5 MOE Gapmers with Mixed Internucleoside Linkages on Human ATXN3 In Vitro, Multiple Doses Modified oligonucleotides selected from the examples above were tested at various doses in A431 cells by free uptake. Compound No. 650528, described in WO 2018/089805, was also tested. Compound No. 650528 is a 5-8-5 MOE gapmer, having a sequence (from 5' to 3') GCATCTTTTCATACTGGC (incorporated herein as SEQ ID NO: 2788), wherein each cytosine is a 5-methyl cytosine, each internucleoside linkage is either a phosphodiester internucleoside linkage or a phosphorothioate internucleoside linkage and the internucleoside linkage motif is sooosssssssssooss, where 's' represents a phosphorothioate internucleoside linkage and 'o' represents a phosphodiester internucleoside linkage, and each of nucleosides 1-5 and 14-18 comprise a 2'-O-methyoxyethyl group.

Cells were plated at a density of 10,000 cells per well with 109.4 nM, 437.5 nM, 1,750.0 nM, and 7,000.0 nM concentrations of modified oligonucleotide, as specified in the tables below. After a treatment period of approximately 48 hours, total RNA was isolated from the cells and ATXN3 RNA levels were measured by RT-qPCR. Human ATXN3 primer probe set RTS38920 (described hereinabove in Example 1) was used to measure RNA levels. ATXN3 RNA levels were adjusted according to total RNA content, as measured by RiboGreen®. Results are presented in the table below as percent ATXN3 RNA levels relative to untreated control cells. As illustrated in the table below, ATXN3 RNA levels were reduced in a dose-dependent manner in modified oligonucleotide-treated cells. $IC_{50}$ was calculated using the "log(inhibitor) vs. response–variable slope (4 parameters)" formula using Prism6 software.

TABLE 7

Dose-dependent reduction of human ATXN3 RNA by modified oligonucleotides

| | ATXN3 level (% control) | | | | |
|---|---|---|---|---|---|
| Compound Number | 109.4 nM | 437.5 nM | 1,750.0 nM | 7,000.0 nM | $IC_{50}$ (μM) |
| 650528 | 100 | 57 | 39 | 30 | 1.3 |
| 1100379 | 77 | 66 | 37 | 23 | 0.9 |
| 1100384 | 86 | 64 | 35 | 25 | 1.0 |
| 1100397 | 68 | 49 | 25 | 15 | 0.4 |

TABLE 7-continued

Dose-dependent reduction of human ATXN3 RNA by modified oligonucleotides

| | ATXN3 level (% control) | | | | |
|---|---|---|---|---|---|
| Compound Number | 109.4 nM | 437.5 nM | 1,750.0 nM | 7,000.0 nM | $IC_{50}$ (μM) |
| 1100398 | 63 | 46 | 26 | 14 | 0.3 |
| 1100399 | 81 | 39 | 39 | 22 | 0.6 |
| 1100403 | 61 | 48 | 32 | 20 | 0.3 |
| 1100405 | 60 | 41 | 25 | 16 | 0.2 |
| 1100406 | 85 | 45 | 24 | 12 | 0.5 |
| 1100407 | 56 | 27 | 15 | 8 | 0.1 |
| 1100408 | 61 | 45 | 21 | 13 | 0.3 |
| 1100409 | 56 | 34 | 19 | 12 | 0.1 |
| 1100410 | 69 | 64 | 38 | 27 | 0.8 |
| 1100429 | 89 | 65 | 38 | 24 | 1.1 |
| 1100430 | 90 | 72 | 53 | 30 | 1.9 |
| 1100434 | 77 | 51 | 30 | 18 | 0.6 |
| 1100468 | 72 | 61 | 44 | 36 | 1.3 |
| 1100475 | 68 | 52 | 28 | 21 | 0.5 |
| 1100479 | 89 | 89 | 56 | 34 | 2.9 |
| 1100557 | 77 | 63 | 47 | 36 | 1.5 |
| 1100559 | 76 | 53 | 29 | 18 | 0.6 |
| 1100560 | 56 | 45 | 27 | 20 | 0.2 |
| 1100566 | 64 | 34 | 13 | 7 | 0.2 |
| 1100567 | 68 | 50 | 31 | 22 | 0.5 |
| 1100568 | 97 | 71 | 41 | 30 | 1.6 |
| 1100571 | 97 | 79 | 38 | 25 | 1.5 |
| 1100572 | 79 | 74 | 45 | 30 | 1.5 |
| 1100574 | 78 | 68 | 46 | 24 | 1.2 |
| 1100580 | 102 | 74 | 43 | 27 | 1.6 |
| 1100583 | 54 | 46 | 26 | 12 | 0.2 |
| 1100584 | 61 | 42 | 23 | 10 | 0.2 |
| 1100585 | 67 | 48 | 25 | 15 | 0.4 |
| 1100589 | 74 | 53 | 32 | 20 | 0.6 |
| 1100590 | 78 | 39 | 17 | 6 | 0.4 |
| 1100591 | 71 | 46 | 26 | 16 | 0.4 |
| 1100592 | 82 | 86 | 56 | 57 | >7.0 |
| 1100597 | 73 | 47 | 26 | 18 | 0.4 |
| 1100641 | 121 | 95 | 78 | 66 | >7.0 |
| 1100666 | 71 | 48 | 31 | 20 | 0.5 |
| 1100667 | 80 | 53 | 38 | 25 | 0.8 |
| 1100668 | 78 | 62 | 39 | 26 | 1.0 |
| 1100669 | 75 | 41 | 23 | 14 | 0.4 |
| 1100673 | 55 | 25 | 15 | 10 | <0.1 |
| 1100697 | 59 | 49 | 27 | 20 | 0.3 |
| 1100719 | 72 | 60 | 28 | 15 | 0.6 |
| 1100725 | 53 | 30 | 17 | 10 | <0.1 |
| 1100729 | 86 | 70 | 44 | 38 | 1.9 |
| 1100730 | 58 | 41 | 25 | 16 | 0.2 |
| 1100732 | 62 | 43 | 23 | 22 | 0.3 |
| 1100753 | 60 | 52 | 33 | 30 | 0.4 |
| 1100756 | 60 | 48 | 35 | 29 | 0.3 |

TABLE 7-continued

Dose-dependent reduction of human ATXN3 RNA by modified oligonucleotides

| Compound Number | ATXN3 level (% control) 109.4 nM | 437.5 nM | 1,750.0 nM | 7,000.0 nM | $IC_{50}$ (μM) |
|---|---|---|---|---|---|
| 1100768 | 76 | 52 | 32 | 19 | 0.6 |
| 1100788 | 88 | 72 | 48 | 30 | 1.7 |
| 1100789 | 90 | 67 | 56 | 40 | 2.8 |
| 1100796 | 63 | 48 | 37 | 26 | 0.4 |
| 1100802 | 50 | 34 | 23 | 19 | <0.1 |
| 1100809 | 56 | 44 | 21 | 19 | 0.2 |
| 1100810 | 65 | 41 | 20 | 14 | 0.3 |
| 1100839 | 63 | 36 | 14 | 8 | 0.2 |
| 1100846 | 104 | 78 | 54 | 29 | 2.2 |
| 1100863 | 44 | 31 | 19 | 15 | <0.1 |
| 1100864 | 67 | 35 | 19 | 16 | 0.2 |
| 1100865 | 56 | 34 | 18 | 13 | 0.1 |
| 1100872 | 65 | 40 | 23 | 13 | 0.3 |
| 1100873 | 46 | 36 | 18 | 12 | <0.1 |
| 1100897 | 74 | 50 | 38 | 33 | 0.8 |
| 1100898 | 72 | 57 | 36 | 31 | 0.8 |
| 1100899 | 68 | 52 | 30 | 24 | 0.5 |
| 1100900 | 58 | 41 | 28 | 23 | 0.2 |
| 1100901 | 43 | 32 | 21 | 17 | <0.1 |
| 1100902 | 58 | 35 | 24 | 19 | 0.2 |
| 1100903 | 72 | 53 | 32 | 24 | 0.6 |
| 1100906 | 56 | 42 | 26 | 16 | 0.2 |
| 1100907 | 26 | 26 | 15 | 12 | <0.1 |
| 1100910 | 55 | 40 | 26 | 19 | 0.2 |
| 1100911 | 75 | 48 | 30 | 18 | 0.5 |
| 1100914 | 27 | 12 | 7 | 5 | <0.1 |
| 1100914 | 26 | 11 | 6 | 5 | <0.1 |
| 1100914 | 26 | 12 | 7 | 7 | <0.1 |
| 1100914 | 29 | 11 | 6 | 5 | <0.1 |
| 1100914 | 38 | 16 | 8 | 5 | <0.1 |
| 1100914 | 34 | 13 | 7 | 5 | <0.1 |
| 1100914 | 28 | 13 | 7 | 5 | <0.1 |
| 1100914 | 27 | 13 | 6 | 5 | <0.1 |
| 1100914 | 33 | 14 | 7 | 5 | <0.1 |
| 1100914 | 33 | 12 | 6 | 6 | <0.1 |
| 1100914 | 30 | 13 | 8 | 6 | <0.1 |
| 1100914 | 28 | 15 | 8 | 6 | <0.1 |
| 1100915 | 51 | 23 | 11 | 6 | <0.1 |
| 1100916 | 35 | 22 | 14 | 12 | <0.1 |
| 1100917 | 48 | 29 | 14 | 10 | <0.1 |
| 1100920 | 46 | 30 | 15 | 9 | <0.1 |
| 1100921 | 70 | 54 | 32 | 20 | 0.5 |
| 1100924 | 57 | 34 | 25 | 19 | 0.1 |
| 1100925 | 76 | 52 | 33 | 23 | 0.6 |
| 1100928 | 39 | 28 | 17 | 14 | <0.1 |
| 1100980 | 51 | 39 | 25 | 16 | 0.1 |
| 1100988 | 62 | 41 | 27 | 22 | 0.3 |
| 1100989 | 64 | 38 | 22 | 14 | 0.2 |
| 1100990 | 36 | 25 | 13 | 12 | <0.1 |
| 1100991 | 55 | 35 | 17 | 13 | 0.1 |
| 1100992 | 69 | 49 | 36 | 29 | 0.6 |
| 1100995 | 80 | 74 | 46 | 37 | 1.9 |
| 1100996 | 60 | 44 | 28 | 18 | 0.3 |
| 1100997 | 66 | 40 | 26 | 16 | 0.3 |
| 1100998 | 79 | 68 | 41 | 28 | 1.2 |
| 1100999 | 70 | 58 | 40 | 34 | 0.9 |
| 1101000 | 61 | 39 | 22 | 18 | 0.2 |
| 1101001 | 53 | 43 | 25 | 22 | 0.2 |
| 1101004 | 73 | 57 | 63 | 41 | 3.3 |
| 1101049 | 69 | 47 | 30 | 24 | 0.4 |
| 1101053 | 82 | 39 | 22 | 16 | 0.4 |
| 1101054 | 62 | 47 | 26 | 21 | 0.3 |
| 1101057 | 72 | 57 | 34 | 26 | 0.7 |
| 1101058 | 94 | 65 | 44 | 20 | 1.2 |
| 1101065 | 60 | 34 | 24 | 20 | 0.2 |
| 1101066 | 69 | 47 | 30 | 22 | 0.4 |
| 1101099 | 55 | 33 | 21 | 16 | 0.1 |
| 1101101 | 40 | 23 | 13 | 12 | <0.1 |
| 1101120 | 66 | 50 | 37 | 30 | 0.5 |
| 1101121 | 71 | 54 | 36 | 20 | 0.6 |
| 1101122 | 77 | 48 | 33 | 25 | 0.6 |
| 1101201 | 60 | 54 | 36 | 34 | 0.5 |

TABLE 7-continued

Dose-dependent reduction of human ATXN3 RNA by modified oligonucleotides

| Compound Number | ATXN3 level (% control) 109.4 nM | 437.5 nM | 1,750.0 nM | 7,000.0 nM | $IC_{50}$ (μM) |
|---|---|---|---|---|---|
| 1101202 | 35 | 21 | 15 | 13 | <0.1 |
| 1101203 | 56 | 40 | 32 | 30 | 0.2 |
| 1101204 | 53 | 42 | 30 | 28 | 0.1 |
| 1101339 | 77 | 60 | 34 | 24 | 0.8 |
| 1101349 | 54 | 42 | 19 | 11 | 0.2 |
| 1101350 | 63 | 43 | 33 | 18 | 0.3 |
| 1101351 | 79 | 58 | 33 | 24 | 0.8 |
| 1101352 | 97 | 55 | 26 | 13 | 0.8 |
| 1101364 | 76 | 53 | 35 | 24 | 0.7 |
| 1101383 | 62 | 46 | 36 | 27 | 0.4 |
| 1101384 | 57 | 44 | 30 | 19 | 0.2 |
| 1101411 | 63 | 26 | 22 | 18 | 0.1 |
| 1101600 | 72 | 42 | 28 | 15 | 0.4 |
| 1101607 | 84 | 66 | 50 | 40 | 2.2 |
| 1101657 | 82 | 55 | 28 | 20 | 0.7 |
| 1101659 | 88 | 59 | 35 | 20 | 0.9 |
| 1101682 | 78 | 58 | 45 | 28 | 1.1 |
| 1101689 | 91 | 61 | 54 | 44 | 2.9 |
| 1101817 | 111 | 106 | 64 | 38 | 4.3 |
| 1101873 | 65 | 49 | 38 | 35 | 0.6 |
| 1101918 | 81 | 77 | 40 | 32 | 1.6 |
| 1101920 | 52 | 41 | 23 | 11 | 0.1 |
| 1101974 | 26 | 7 | 4 | 4 | <0.1 |
| 1101975 | 32 | 15 | 7 | 5 | <0.1 |
| 1102024 | 63 | 44 | 21 | 10 | 0.3 |
| 1102028 | 41 | 20 | 9 | 6 | <0.1 |
| 1102049 | 61 | 45 | 30 | 19 | 0.3 |
| 1102050 | 61 | 27 | 13 | 8 | 0.1 |
| 1102052 | 63 | 51 | 32 | 26 | 0.4 |
| 1102074 | 41 | 21 | 12 | 6 | <0.1 |
| 1102077 | 73 | 61 | 37 | 25 | 0.8 |
| 1102084 | 59 | 41 | 21 | 18 | 0.2 |
| 1102085 | 55 | 43 | 19 | 15 | 0.2 |
| 1102090 | 69 | 44 | 27 | 20 | 0.4 |
| 1102103 | 83 | 54 | 34 | 19 | 0.7 |
| 1102104 | 55 | 28 | 10 | 8 | <0.1 |
| 1102108 | 79 | 67 | 45 | 21 | 1.1 |
| 1102110 | 87 | 48 | 26 | 14 | 0.6 |
| 1102119 | 109 | 109 | 76 | 60 | >7.0 |
| 1102128 | 77 | 58 | 30 | 16 | 0.6 |
| 1102129 | 83 | 58 | 37 | 28 | 1.0 |
| 1102130 | 58 | 38 | 20 | 13 | 0.2 |
| 1102131 | 73 | 57 | 30 | 16 | 0.6 |
| 1102134 | 84 | 73 | 55 | 34 | 2.3 |
| 1102180 | 82 | 55 | 42 | 32 | 1.1 |
| 1102195 | 83 | 73 | 49 | 36 | 2.1 |
| 1102198 | 60 | 41 | 26 | 15 | 0.2 |
| 1102200 | 95 | 69 | 47 | 27 | 1.6 |
| 1102202 | 91 | 56 | 32 | 19 | 0.8 |
| 1102239 | 78 | 64 | 42 | 33 | 1.3 |
| 1102262 | 88 | 71 | 48 | 34 | 1.9 |
| 1102328 | 60 | 50 | 33 | 21 | 0.3 |
| 1102329 | 65 | 37 | 22 | 11 | 0.2 |
| 1102336 | 58 | 34 | 20 | 13 | 0.2 |
| 1102351 | 66 | 53 | 29 | 28 | 0.5 |
| 1102353 | 69 | 50 | 23 | 11 | 0.4 |
| 1102374 | 78 | 67 | 53 | 36 | 2.0 |
| 1102379 | 67 | 59 | 32 | 21 | 0.6 |
| 1102385 | 69 | 38 | 20 | 15 | 0.3 |
| 1102424 | 79 | 72 | 46 | 27 | 1.4 |
| 1102541 | 63 | 50 | 26 | 17 | 0.3 |
| 1102547 | 94 | 78 | 59 | 51 | >7.0 |
| 1102551 | 87 | 50 | 23 | 11 | 0.6 |
| 1102552 | 67 | 51 | 30 | 28 | 0.5 |
| 1102557 | 74 | 35 | 21 | 10 | 0.3 |
| 1102562 | 73 | 60 | 35 | 20 | 0.7 |
| 1102563 | 64 | 49 | 36 | 22 | 0.4 |
| 1102573 | 82 | 46 | 26 | 18 | 0.6 |
| 1102574 | 61 | 43 | 24 | 17 | 0.2 |
| 1102579 | 62 | 59 | 32 | 22 | 0.5 |
| 1102580 | 67 | 46 | 26 | 16 | 0.4 |
| 1102598 | 93 | 54 | 26 | 14 | 0.7 |

TABLE 7-continued

Dose-dependent reduction of human ATXN3 RNA by modified oligonucleotides

| Compound Number | ATXN3 level (% control) 109.4 nM | 437.5 nM | 1,750.0 nM | 7,000.0 nM | $IC_{50}$ (μM) |
|---|---|---|---|---|---|
| 1102599 | 66 | 47 | 23 | 11 | 0.3 |
| 1102600 | 77 | 56 | 35 | 22 | 0.7 |
| 1102612 | 71 | 51 | 35 | 24 | 0.6 |
| 1102637 | 92 | 63 | 37 | 21 | 1.1 |
| 1102646 | 75 | 56 | 35 | 30 | 0.8 |
| 1102655 | 82 | 83 | 55 | 38 | 3.1 |
| 1102657 | 71 | 39 | 18 | 12 | 0.3 |
| 1102663 | 63 | 55 | 38 | 27 | 0.5 |
| 1102666 | 58 | 30 | 15 | 9 | 0.1 |
| 1102667 | 73 | 50 | 26 | 15 | 0.5 |
| 1102668 | 88 | 64 | 44 | 32 | 1.5 |
| 1102669 | 67 | 68 | 48 | 32 | 1.4 |
| 1102677 | 68 | 49 | 27 | 20 | 0.4 |
| 1102678 | 65 | 35 | 25 | 17 | 0.2 |
| 1102679 | 72 | 58 | 48 | 36 | 1.3 |
| 1102683 | 55 | 45 | 31 | 17 | 0.2 |
| 1102684 | 82 | 44 | 20 | 12 | 0.5 |
| 1102690 | 68 | 60 | 36 | 33 | 0.8 |
| 1102695 | 90 | 53 | 27 | 18 | 0.7 |
| 1102722 | 67 | 39 | 20 | 9 | 0.3 |
| 1102723 | 71 | 48 | 28 | 21 | 0.5 |
| 1102725 | 48 | 37 | 23 | 10 | <0.1 |
| 1102726 | 88 | 56 | 40 | 25 | 1.0 |
| 1102734 | 81 | 57 | 31 | 19 | 0.7 |
| 1102750 | 69 | 61 | 35 | 23 | 0.7 |
| 1102759 | 69 | 51 | 26 | 24 | 0.4 |
| 1102760 | 73 | 70 | 59 | 47 | 5.5 |
| 1102789 | 76 | 65 | 38 | 23 | 0.9 |
| 1102794 | 55 | 29 | 13 | 8 | <0.1 |
| 1102801 | 80 | 56 | 36 | 29 | 0.9 |
| 1102802 | 77 | 56 | 28 | 23 | 0.6 |
| 1102811 | 29 | 16 | 8 | 6 | <0.1 |
| 1102841 | 64 | 39 | 29 | 23 | 0.3 |

Example 3: Tolerability of Modified Oligonucleotides Complementary to Human ATXN3 in Wild-Type Mice Modified oligonucleotides described above were tested in wild-type female C57/Bl6 mice to assess the tolerability of the oligonucleotides. Wild-type female C57/Bl6 mice each received a single ICV dose of 700 μg of modified oligonucleotide listed in the table below. Each treatment group consisted of 2 mice. A group of 2 mice received PBS as a negative control. At 3 hours post-injection, mice were evaluated according to 7 different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB score). After all 7 criteria were evaluated, the scores were summed for each mouse and averaged within each treatment group. The results are presented in the table below.

TABLE 8

FOB scores in wild-type mice

| Compound Number | 3 hour FOB |
|---|---|
| PBS | 0.00 |
| 1100397 | 0.00 |
| 1100405 | 0.00 |
| 1100406 | 0.00 |
| 1100407 | 1.00 |
| 1100528 | 1.00 |
| 1100534 | 2.00 |
| 1100535 | 2.00 |
| 1100540 | 3.50 |
| 1100542 | 1.50 |
| 1100566 | 3.00 |
| 1100585 | 0.00 |
| 1100590 | 2.00 |
| 1100725 | 3.00 |
| 1100873 | 0.00 |
| 1100914 | 4.50 |
| 1100915 | 5.00 |
| 1100920 | 0.00 |
| 1100990 | 6.50 |
| 1100991 | 5.00 |
| 1101101 | 3.50 |
| 1101339 | 6.00 |
| 1101351 | 1.00 |
| 1101974 | 0.00 |
| 1101975 | 0.00 |
| 1102024 | 0.00 |
| 1102028 | 0.00 |
| 1102050 | 6.50 |
| 1102130 | 0.00 |
| 1102131 | 0.00 |
| 1102336 | 0.00 |
| 1102353 | 0.00 |
| 1102551 | 5.00 |
| 1102557 | 5.50 |
| 1102574 | 0.00 |
| 1102580 | 0.00 |
| 1102599 | 0.00 |
| 1102657 | 0.00 |
| 1102811 | 0.50 |
| 1102970 | 0.00 |
| 1102977 | 0.00 |
| 1102978 | 0.00 |
| 1102979 | 0.00 |
| 1103103 | 2.00 |

TABLE 9

FOB scores in wild-type mice

| Compound Number | 3 hour FOB |
|---|---|
| PBS | 0.00 |
| 1100379 | 0.00 |
| 1100398 | 1.00 |
| 1100399 | 3.00 |
| 1100409 | 4.00 |
| 1100521 | 4.00 |
| 1100527 | 1.00 |
| 1100536 | 3.00 |
| 1100541 | 4.00 |
| 1100544 | 4.00 |
| 1100571 | 3.00 |
| 1100572 | 2.00 |
| 1100667 | 5.50 |
| 1100673 | 1.00 |
| 1100730 | 3.00 |
| 1100732 | 3.00 |
| 1100809 | 1.00 |
| 1100864 | 2.00 |
| 1100865 | 1.00 |
| 1100907 | 4.00 |

TABLE 9-continued

| FOB scores in wild-type mice | |
|---|---|
| Compound Number | 3 hour FOB |
| 1100911 | 1.00 |
| 1100980 | 4.00 |
| 1101054 | 2.00 |
| 1101065 | 4.00 |
| 1101121 | 3.00 |
| 1101122 | 2.00 |
| 1101350 | 3.00 |
| 1101352 | 3.00 |
| 1101411 | 1.00 |
| 1101657 | 1.00 |
| 1102084 | 2.00 |
| 1102090 | 3.00 |
| 1102128 | 3.00 |
| 1102198 | 1.00 |
| 1102562 | 3.00 |
| 1102563 | 3.00 |
| 1102612 | 3.00 |
| 1102667 | 1.00 |
| 1102677 | 3.00 |
| 1102683 | 1.00 |
| 1102684 | 1.00 |
| 1102725 | 2.50 |
| 1102980 | 1.00 |
| 1103001 | 3.00 |
| 1103014 | 1.00 |
| 1103069 | 2.00 |

Example 4: Activity of Modified Oligonucleotides Complementary to Human ATXN3 in Transgenic Mice Modified oligonucleotides described above were tested in the ATXN3 YAC transgenic mouse model which contains the full-length human ATXN3 disease gene harboring an expanded CAG repeat ($CAG_{84}$, Q84). The hemizygous SCA3-Q84.2 mice are designated as wt/Q84 and were described in Costa Mdo C., et al., *Toward RNAi Therapy for the Polyglutamine Disease Machado-Joseph Disease*. Mol Ther, 2013, 21 (10): 1898-908." Compound No. 650528, described hereinabove and in WO 2018/089805, was also tested.

The ATXN3 transgenic mice were divided into groups of 3 mice each. Mice in each group were given a single ICV bolus of oligonucleotide at a dose of 300 μg and sacrificed two weeks later. A group of 4-6 mice was injected with PBS and served as the control group to which oligonucleotide-treated groups were compared. After two weeks, mice were sacrificed and RNA was extracted from brain tissue for real-time PCR analysis of measurement of RNA expression of ATXN3 using primer probe set RTS39540 (forward sequence CCTTCTTCCTGCGCCTTATT, designated herein as SEQ ID NO: 12; reverse sequence TCATGGTGGGTACGTATGTTTAG, designated herein as SEQ ID NO: 13; probe sequence AGTATGCAGGCAAGTCTCCTTCTGT, designated herein as SEQ ID NO: 14). Results are presented as percent change of RNA, relative to PBS control, normalized with cyclophilin A. As shown in the tables below, human ATXN3 RNA was reduced in various tissues.

TABLE 10

Reduction of human ATXN3 RNA in transgenic mice

| | hATXN3 Expression (% control) | | | |
|---|---|---|---|---|
| Compound Number | Spinal cord | Cortex | Cerebellum | Brain Stem |
| PBS | 100 | 100 | 100 | 100 |
| 650528 | 29 | 43 | 76 | 30 |
| 1100914 | 17 | 24 | 68 | 16 |
| 1100873 | 48 | 82 | 71 | 57 |
| 1100585 | 56 | 77 | 70 | 54 |
| 1100590 | 21 | 34 | 54 | 73 |
| 1102130 | 33 | 54 | 63 | 22 |
| 1102977 | 45 | 61 | 78 | 33 |
| 1102353 | 33 | 48 | 69 | 57 |
| 1102599 | 28 | 54 | 57 | 42 |
| 1102979 | 34 | 53 | 87 | 34 |
| 1102978 | 60 | 76 | 76 | 37 |
| 1101920 | 55 | 79 | 70 | 68 |
| 1100572 | 56 | 87 | 70 | 70 |
| 1100571 | 33 | 55 | 55 | 79 |
| 1100667 | 59 | 86 | 100 | 39 |

TABLE 11

Reduction of human ATXN3 RNA in transgenic mice

| | hATXN3 Expression (% control) | | | |
|---|---|---|---|---|
| Compound Number | Spinal cord | Cortex | Cerebellum | Brain Stem |
| PBS | 100 | 100 | 100 | 100 |
| 650528 | 25 | 42 | 71 | 29 |
| 1100914 | 15 | 19 | 56 | 17 |
| 1100528 | 71 | 67 | 80 | 68 |
| 1100915 | 27 | 27 | 46 | 27 |
| 1100397 | 49 | 58 | 60 | 52 |
| 1100406 | 55 | 58 | 69 | 51 |
| 1102050 | 41 | 46 | 67 | 37 |
| 1102024 | 47 | 41 | 72 | 51 |
| 1101101 | 31 | 37 | 71 | 34 |
| 1102551 | 56 | 62 | 76 | 61 |
| 1102574 | 29 | 40 | 60 | 30 |
| 1102970 | 64 | 60 | 85 | 68 |
| 1102336 | 53 | 42 | 68 | 58 |
| 1102811 | 16 | 22 | 40 | 17 |
| 1102028 | 25 | 25 | 59 | 23 |
| 1100434 | 78 | 75 | 84 | 78 |
| 1100559 | 53 | 41 | 76 | 50 |
| 1101121 | 40 | 46 | 61 | 37 |
| 1100992 | 45 | 49 | 56 | 41 |
| 1100468 | 58 | 59 | 74 | 53 |
| 1100544 | 81 | 62 | 88 | 73 |
| 1100810 | 57 | 95 | 65 | 47 |
| 1100379 | 55 | 54 | 66 | 52 |
| 1100673 | 9 | 12 | 67 | 11 |
| 1102669 | 72 | 69 | 81 | 70 |
| 1102725 | 50 | 49 | 76 | 50 |
| 1103014 | 50 | 52 | 70 | 40 |
| 1102667 | 55 | 111 | 72 | 58 |

TABLE 12

Reduction of human ATXN3 RNA in transgenic mice

| | hATXN3 Expression (% control) | | | |
|---|---|---|---|---|
| Compound Number | Spinal cord | Cortex | Cerebellum | Brain Stem |
| PBS | 100 | 100 | 100 | 100 |
| 650528 | 24 | 43 | 80 | 31 |
| 1100914 | 14 | 18 | 59 | 15 |

TABLE 12-continued

Reduction of human ATXN3 RNA in transgenic mice

| Compound Number | hATXN3 Expression (% control) Spinal cord | Cortex | Cerebellum | Brain Stem |
|---|---|---|---|---|
| 1100429 | 69 | 72 | 80 | 80 |
| 1100542 | 78 | 78 | 84 | 73 |
| 1100991 | 26 | 51 | 71 | 53 |
| 1100725 | 18 | 27 | 67 | 22 |
| 1102084 | 46 | 72 | 88 | 55 |
| 1101351 | 66 | 87 | 92 | 65 |
| 1102131 | 35 | 36 | 76 | 37 |
| 1103103 | 28 | 42 | 75 | 36 |
| 1102557 | 58 | 79 | 87 | 74 |
| 1102657 | 12 | 19 | 59 | 17 |
| 1100839 | 25 | 40 | 54 | 35 |
| 1100864 | 41 | 68 | 67 | 54 |
| 1100907 | 32 | 49 | 63 | 41 |

TABLE 13

Reduction of human ATXN3 RNA in transgenic mice

| Compound Number | hATXN3 Expression (% control) Spinal cord | Cortex | Cerebellum | Brain Stem |
|---|---|---|---|---|
| PBS | 100 | 100 | 100 | 100 |
| 650528 | 24 | 37 | 93 | 31 |
| 1100914 | 14 | 22 | 68 | 19 |
| 1102108 | 61 | 54 | 88 | 63 |
| 1100697 | 44 | 48 | 75 | 39 |
| 1100902 | 38 | 45 | 83 | 39 |
| 1101383 | 52 | 65 | 101 | 65 |
| 1100900 | 46 | 62 | 92 | 56 |
| 1102562 | 45 | 54 | 64 | 55 |
| 1102637 | 30 | 29 | 50 | 34 |
| 1101203 | 52 | 65 | 70 | 68 |
| 1102612 | 33 | 47 | 73 | 39 |
| 1102198 | 51 | 75 | 96 | 66 |

TABLE 14

Reduction of human ATXN3 RNA in transgenic mice

| Compound Number | hATXN3 Expression (% control) Spinal cord | Cortex | Cerebellum | Brain Stem |
|---|---|---|---|---|
| PBS | 100 | 100 | 100 | 100 |
| 650528 | 28 | 48 | 69 | 31 |
| 1100914 | 20 | 17 | 52 | 16 |
| 1102677 | 83 | 95 | 88 | 86 |
| 1102998 | 41 | 51 | 82 | 47 |
| 1103069 | 25 | 39 | 67 | 29 |
| 1100753 | 39 | 48 | 51 | 37 |

TABLE 15

Reduction of human ATXN3 RNA in transgenic mice

| Compound Number | hATXN3 Expression (% control) Spinal cord | Cortex | Cerebellum | Brain Stem |
|---|---|---|---|---|
| PBS | 100 | 100 | 100 | 100 |
| 650528 | 23 | 38 | 74 | 30 |
| 1100914 | 13 | 15 | 50 | 18 |

TABLE 15-continued

Reduction of human ATXN3 RNA in transgenic mice

| Compound Number | hATXN3 Expression (% control) Spinal cord | Cortex | Cerebellum | Brain Stem |
|---|---|---|---|---|
| 1100920 | 76 | 86 | 104 | 84 |
| 1101352 | 68 | 84 | 93 | 69 |
| 1101099 | 54 | 68 | 101 | 62 |
| 1100990 | 15 | 41 | 60 | 22 |
| 1100872 | 53 | 65 | 81 | 62 |
| 1101122 | 30 | 23 | 61 | 31 |
| 1100898 | 34 | 37 | 84 | 34 |
| 1101918 | 69 | 93 | 71 | 71 |
| 1100405 | 49 | 58 | 98 | 45 |
| 1102580 | 56 | 79 | 85 | 49 |
| 1100407 | 50 | 63 | 91 | 50 |
| 1101054 | 29 | 31 | 75 | 36 |
| 1101350 | 56 | 74 | 78 | 64 |
| 1101975 | 31 | 58 | 70 | 38 |
| 1100921 | 64 | 86 | 83 | 65 |

TABLE 16

Reduction of human ATXN3 RNA in transgenic mice

| Compound Number | hATXN3 Expression (% control) Spinal cord | Cortex | Cerebellum | Brain Stem |
|---|---|---|---|---|
| PBS | 100 | 100 | 100 | 100 |
| 650528 | 25 | 54 | 58 | 26 |
| 1100914 | 13 | 13 | 39 | 15 |
| 1100865 | 37 | 37 | 60 | 36 |
| 1100730 | 19 | 26 | 34 | 20 |
| 1100584 | 47 | 45 | 51 | 45 |
| 1101120 | 49 | 65 | 67 | 47 |
| 1100911 | 36 | 52 | 54 | 38 |
| 1102090 | 38 | 50 | 71 | 36 |
| 1102128 | 34 | 41 | 56 | 31 |
| 1100541 | 57 | 72 | 74 | 68 |
| 1100809 | 40 | 48 | 69 | 37 |
| 1102541 | 51 | 75 | 56 | 56 |
| 1102666 | 34 | 52 | 58 | 31 |
| 1100398 | 60 | 64 | 65 | 64 |
| 1100399 | 46 | 49 | 59 | 47 |
| 1100410 | 52 | 69 | 70 | 48 |
| 1100732 | 55 | 80 | 72 | 58 |

TABLE 17

Reduction of human ATXN3 RNA in transgenic mice

| Compound Number | hATXN3 Expression (% control) Spinal cord | Cortex | Cerebellum | Brain Stem |
|---|---|---|---|---|
| PBS | 100 | 100 | 100 | 100 |
| 650528 | 21 | 38 | 67 | 26 |
| 1100914 | 14 | 18 | 43 | 16 |
| 1100557 | 53 | 78 | 78 | 74 |
| 1100980 | 23 | 45 | 80 | 24 |
| 1102600 | 48 | 55 | 86 | 44 |
| 1102980 | 41 | 43 | 67 | 43 |
| 1101657 | 17 | 23 | 57 | 19 |
| 1102684 | 65 | 85 | 110 | 73 |
| 1101202 | 28 | 33 | 66 | 27 |
| 1101659 | 29 | 39 | 77 | 27 |
| 1102103 | 36 | 43 | 81 | 41 |
| 1101873 | 41 | 49 | 80 | 41 |
| 1102202 | 69 | 78 | 98 | 70 |
| 1102180 | 68 | 72 | 106 | 75 |

TABLE 17-continued

Reduction of human ATXN3 RNA in transgenic mice

| Compound Number | hATXN3 Expression (% control) Spinal cord | Cortex | Cerebellum | Brain Stem |
|---|---|---|---|---|
| 1102239 | 63 | 68 | 92 | 82 |
| 1102678 | 73 | 79 | 92 | 77 |
| 1102052 | 68 | 83 | 100 | 72 |

TABLE 18

Reduction of human ATXN3 RNA in transgenic mice

| Compound Number | hATXN3 Expression (% control) Spinal cord | Cortex | Cerebellum | Brain Stem |
|---|---|---|---|---|
| PBS | 100 | 100 | 100 | 100 |
| 650528 | 28 | 35 | 83 | 27 |
| 1100914 | 13 | 11 | 46 | 12 |
| 1102129 | 28 | 26 | 56 | 20 |
| 1101053 | 42 | 56 | 97 | 43 |
| 1100430 | 81 | 75 | 76 | 78 |
| 1100666 | 50 | 44 | 70 | 47 |
| 1100756 | 45 | 64 | 71 | 42 |
| 1102598 | 33 | 31 | 56 | 30 |
| 1100863 | 52 | 53 | 77 | 52 |
| 1102646 | 63 | 80 | 87 | 62 |
| 1102750 | 59 | 66 | 70 | 57 |
| 1100802 | 29 | 36 | 61 | 36 |
| 1100906 | 44 | 46 | 69 | 52 |
| 1102379 | 64 | 69 | 94 | 72 |
| 1102663 | 60 | 83 | 63 | 69 |
| 1102679 | 80 | 93 | 92 | 92 |

Example 5: Tolerability of Modified Oligonucleotides Complementary to Human ATXN3 in Wild-Type Mice Modified oligonucleotides described above were tested in wild-type female C57/Bl6 mice to assess the tolerability of the oligonucleotides. Wild-type female C57/Bl6 mice each received a single ICV dose of 700 μg of modified oligonucleotide listed in the table below. Each treatment group consisted of 4 mice. A group of 3-4 mice received PBS as a negative control. Also tested in several studies were comparator Compound No. 650528, a 5-8-5 MOE gapmer with mixed PO/PS internucleoside linkages complementary to human ATXN3 described hereinabove and in WO 2018/089805 and the following LNA comparator compounds: Compound No. 1244463 (a 3-9-3 LNA gapmer with uniform PS internucleoside linkages complementary to human ATXN3); Compound No. 1244464 (a 3-10-3 LNA gapmer with uniform PS internucleoside linkages complementary to human ATXN3); Compound No. 1244465 (a 3-10-3 LNA gapmer with uniform PS internucleoside linkages complementary to human ATXN3); Compound No. 1244466 (a 3-9-3 LNA gapmer with uniform PS internucleoside linkages complementary to human ATXN3); and Compound No. 1244467 (a 2-9-3 LNA gapmer with uniform PS internucleoside linkages complementary to human ATXN3), described in WO2013/138353 were tested.

At 3 hours post-injection, mice were evaluated according to 7 different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB score). After all 7 criteria were evaluated, the scores were summed for each mouse and averaged within each treatment group. The results are presented in the table below.

TABLE 19

FOB scores in wild-type mice

| Compound Number | 3 hour FOB |
|---|---|
| PBS | 0.00 |
| 650528 | 0.00 |
| 1100559 | 4.00 |
| 1100802 | 5.75 |
| 1100839 | 4.25 |
| 1100898 | 0.00 |
| 1100914 | 5.25 |
| 1101202 | 5.25 |
| 1101659 | 1.50 |
| 1102129 | 2.75 |
| 1102598 | 0.00 |
| 1102637 | 3.50 |

TABLE 20

FOB scores in wild-type mice

| Compound Number | 3 hour FOB |
|---|---|
| 650528 | 0.00 |
| 1100408 | 6.25 |
| 1100673 | 0.00 |
| 1100725 | 4.50 |
| 1100730 | 2.75 |
| 1100914 | 4.00 |
| 1100917 | 6.00 |
| 1101000 | 4.75 |
| 1101122 | 3.25 |
| 1101657 | 0.00 |
| 1102130 | 0.00 |
| 1102131 | 0.75 |
| 1102574 | 1.00 |
| 1102811 | 2.25 |

TABLE 21

FOB scores in wild-type mice

| Compound Number | 3 hour FOB |
|---|---|
| PBS | 0.00 |
| 1100369 | 0.25 |
| 1100479 | 3.25 |
| 1100505 | 5.00 |
| 1100508 | 6.00 |
| 1101375 | 0.00 |
| 1101721 | 5.00 |
| 1101853 | 0.00 |
| 1102690* | 0.00 |
| 1102706 | 1.00 |
| 1102808 | 1.75 |
| 1103041 | 3.00 |

TABLE 22

| FOB scores in wild-type mice | |
|---|---|
| Compound Number | 3 hour FOB |
| PBS | 0.00 |
| 1101736 | 0.00 |

TABLE 23

| FOB scores in wild-type mice | |
|---|---|
| Compound Number | 3 hour FOB |
| PBS | 0.00 |
| 1100505 | 4.00 |
| 1100506 | 1.50 |
| 1100672 | 0.00 |
| 1100731 | 1.25 |
| 1102811 | 2.25 |
| 1103041 | 3.25 |

TABLE 24

| FOB scores in wild-type mice | |
|---|---|
| Compound Number | 3 hour FOB |
| PBS | 0.00 |
| 1100723 | 0.00 |
| 1100724 | 1.00 |
| 1100728 | 0.75 |
| 1100729 | 0.50 |

TABLE 25

| FOB scores in wild-type mice | |
|---|---|
| Compound Number | 3 hour FOB |
| PBS | 0.00 |
| 1100506 | 2.00 |
| 1100731 | 3.75 |

TABLE 26

| FOB scores in wild-type mice | |
|---|---|
| Compound Number | 3 hour FOB |
| PBS | 0.00 |
| 1244463 | 7.00 |
| 1244464 | 7.00 |
| 1244465 | 7.00 |
| 1244466 | 7.00 |
| 1244467 | 7.00 |

Example 6: Activity of Modified Oligonucleotides Complementary to Human ATXN3 RNA in Transgenic Mice Modified oligonucleotides were tested in the ATXN3 YAC transgenic mouse model which contains the full-length human ATXN3 disease gene harboring an expanded CAG repeat ($CAG_{84}$, Q84). The hemizygous SCA3-Q84.2 mice are designated as wt/Q84 and were described in Costa Mdo C., et al., *Toward RNAi Therapy for the Polyglutamine Disease Machado-Joseph Disease*. Mol Ther, 2013, 21 (10): 1898-908.

The ATXN3 transgenic mice were divided into groups of 2-3 mice each. Mice in each group were given a single ICV bolus of oligonucleotide at a dose of 300 μg and sacrificed two weeks later. A group of 2 to 5 mice was injected with PBS and served as the control group to which oligonucleotide-treated groups were compared. After two weeks, mice were sacrificed, and RNA was extracted from various regions of the central nervous system. ATXN3 RNA levels were measured by quantitative real-time RTPCR using human primer probe set RTS43981 (forward sequence TGACACAGACATCAGGTACAAATC, designated herein as SEQ ID NO: 2798; reverse sequence TGCTGCTGTTGCTGCTT, designated herein as SEQ ID NO: 2799; probe sequence AGCTTCGGAAGAGACGAGAAGCCTA, designated herein as SEQ ID NO: 2800). Results are presented as percent change of RNA, relative to PBS control, normalized to mouse cyclophilin A measured using mouse primer probe set m_cyclo24 (forward sequence TCGCCGCTTGCTGCA, designated herein as SEQ ID NO: 2801; reverse sequence ATCGGCCGTGATGTCGA, designated herein as SEQ ID NO: 2802; probe sequence CCATGGTCAACCCCACCGTGTTC, designated herein as SEQ ID NO: 2803). Also tested in several studies was comparator Compound No. 650528, a 5-8-5 MOE gapmer with mixed PO/PS internucleoside linkages complementary to human ATXN3 described hereinabove and in WO 2018/089805. As shown in the tables below, human ATXN3 RNA was reduced in various tissues.

TABLE 27

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 38 | 41 | 79 | 40 |
| 1100408 | 28 | 40 | 68 | 32 |
| 1100409 | 30 | 55 | 59 | 36 |
| 1100521 | 68 | 87 | 83 | 74 |
| 1100527 | 76 | 83 | 79 | 82 |
| 1100534 | 57 | 71 | 97 | 59 |
| 1100535 | 77 | 96 | 100 | 84 |
| 1100536 | 76 | 103 | 80 | 90 |
| 1100540 | 67 | 69 | 89 | 68 |
| 1100566 | 68 | 94 | 85 | 74 |
| 1100673 | 17 | 14 | 53 | 16 |
| 1100914 | 23 | 17 | 50 | 24 |
| 1101000 | 34 | 37 | 69 | 34 |
| 1101065 | 43 | 62 | 66 | 42 |
| 1101339 | 51 | 56 | 78 | 57 |
| 1101411 | 29 | 52 | 56 | 30 |
| 1101974 | 17 | 22 | 50 | 19 |
| 1102329 | 46 | 48 | 73 | 49 |
| 1102563 | 42 | 45 | 78 | 41 |
| 1102657 | 20 | 18 | 52 | 19 |
| 1102683 | 27 | 29 | 60 | 27 |
| 1102811 | 27 | 38 | 66 | 23 |
| 1103001 | 45 | 53 | 71 | 52 |

TABLE 28

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 30 | 42 | 67 | 34 |
| 1100670 | 61 | 75 | 72 | 54 |
| 1100671 | 60 | 70 | 73 | 45 |
| 1100674 | 64 | 74 | 84 | 58 |
| 1100910 | 34 | 43 | 62 | 37 |
| 1100912 | 55 | 52 | 71 | 53 |
| 1100917 | 38 | 32 | 68 | 35 |

TABLE 29

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 39 | 61 | 81 | 38 |
| 1100505 | 32 | 38 | 64 | 34 |
| 1100522 | 59 | 85 | 89 | 64 |
| 1100523 | 88 | 103 | 83 | 96 |
| 1100597 | 63 | 85 | 85 | 71 |
| 1100914 | 22 | 29 | 63 | 28 |
| 1101349 | 45 | 70 | 71 | 52 |
| 1101370 | 67 | 107 | 97 | 71 |
| 1101600 | 41 | 47 | 70 | 44 |
| 1102328 | 39 | 57 | 66 | 37 |
| 1102794 | 51 | 71 | 86 | 62 |
| 1102939 | 63 | 63 | 87 | 76 |
| 1102941 | 50 | 80 | 84 | 60 |
| 1103073 | 44 | 73 | 68 | 51 |
| 1103116 | 44 | 63 | 78 | 47 |

TABLE 30

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 32 | 48 | 74 | 34 |
| 1100369 | 22 | 40 | 54 | 30 |
| 1100382 | 64 | 78 | 66 | 53 |
| 1100384 | 56 | 94 | 67 | 53 |
| 1100454 | 44 | 72 | 49 | 45 |
| 1101388 | 58 | 53 | 74 | 48 |
| 1101601 | 56 | 62 | 62 | 58 |
| 1101615 | 81 | 108 | 85 | 82 |
| 1101721 | 21 | 46 | 61 | 29 |
| 1101755 | 53 | 82 | 59 | 60 |
| 1101926 | 67 | 87 | 71 | 63 |
| 1101992 | 93 | 89 | 78 | 79 |
| 1102043 | 71 | 86 | 69 | 60 |
| 1102062 | 45 | 70 | 66 | 55 |
| 1102147 | 58 | 55 | 56 | 48 |
| 1102166 | 72 | 85 | 69 | 56 |
| 1102216 | 39 | 52 | 60 | 42 |
| 1102322 | 71 | 88 | 67 | 62 |
| 1102361 | 66 | 106 | 75 | 80 |
| 1102424 | 52 | 72 | 68 | 61 |
| 1102692 | 62 | 59 | 64 | 54 |
| 1102793 | 64 | 107 | 76 | 81 |
| 1103067 | 61 | 104 | 75 | 86 |
| 1103077 | 64 | 82 | 74 | 66 |
| 1103084 | 37 | 60 | 69 | 53 |

TABLE 31

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 49 | 30 | 90 | 43 |
| 1100479 | 57 | 34 | 71 | 47 |
| 1101375 | 59 | 45 | 74 | 48 |
| 1101609 | 86 | 84 | 104 | 83 |
| 1101667 | 84 | 68 | 100 | 82 |
| 1101764 | 85 | 68 | 93 | 72 |
| 1101853 | 65 | 45 | 78 | 53 |
| 1101962 | 79 | 59 | 92 | 67 |
| 1102195 | 111 | 65 | 98 | 73 |
| 1102426 | 76 | 61 | 79 | 69 |
| 1102690 | 53 | 33 | 80 | 42 |
| 1102787 | 78 | 65 | 106 | 87 |
| 1102808 | 65 | 47 | 88 | 58 |
| 1102865 | 92 | 72 | 101 | 81 |
| 1102957 | 75 | 58 | 81 | 71 |
| 1102981 | 76 | 56 | 94 | 66 |
| 1102997 | 85 | 62 | 97 | 74 |
| 1103105 | 68 | 49 | 85 | 56 |

TABLE 32

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 38 | 43 | 84 | 42 |
| 1100514 | 70 | 79 | 87 | 81 |
| 1101616 | 48 | 50 | 75 | 57 |
| 1101683 | 71 | 83 | 90 | 88 |
| 1101689 | 61 | 73 | 85 | 71 |
| 1101786 | 87 | 101 | 113 | 99 |
| 1101811 | 66 | 90 | 90 | 73 |
| 1101817 | 88 | 73 | 98 | 96 |
| 1101828 | 89 | 102 | 97 | 104 |
| 1102097 | 75 | 90 | 100 | 83 |
| 1102144 | 58 | 73 | 86 | 74 |
| 1102162 | 71 | 79 | 90 | 81 |
| 1102220 | 57 | 54 | 84 | 59 |
| 1102228 | 78 | 102 | 108 | 103 |
| 1102283 | 52 | 57 | 84 | 63 |
| 1102335 | 69 | 91 | 100 | 73 |
| 1102589 | 86 | 95 | 101 | 93 |
| 1102648 | 73 | 83 | 84 | 82 |
| 1102706 | 39 | 36 | 69 | 38 |
| 1102746 | 61 | 64 | 94 | 69 |
| 1102757 | 40 | 62 | 74 | 49 |
| 1102761 | 47 | 60 | 73 | 58 |
| 1102792 | 68 | 80 | 92 | 79 |
| 1102876 | 46 | 50 | 81 | 55 |
| 1102974 | 102 | 106 | 109 | 104 |

TABLE 33

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 32 | 42 | 77 | 39 |
| 1100475 | 46 | 51 | 78 | 37 |
| 1100508 | 33 | 28 | 30 | 29 |
| 1101718 | 45 | 40 | 71 | 49 |
| 1101808 | 76 | 87 | 78 | 78 |

TABLE 33-continued

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 1101821 | 73 | 75 | 79 | 68 |
| 1101912 | 67 | 74 | 87 | 53 |
| 1101927 | 77 | 80 | 75 | 75 |
| 1101958 | 72 | 66 | 68 | 44 |
| 1102073 | 61 | 68 | 69 | 63 |
| 1102074 | 42 | 47 | 72 | 42 |
| 1102110 | 80 | 88 | 87 | 78 |
| 1102385 | 42 | 58 | 75 | 40 |
| 1102555* | 86 | 85 | 79 | 64 |
| 1102722 | 78 | 91 | 80 | 75 |
| 1102734 | 43 | 69 | 77 | 50 |
| 1102789 | 65 | 73 | 82 | 59 |
| 1102848 | 76 | 92 | 96 | 84 |
| 1102953 | 80 | 82 | 81 | 78 |
| 1103012 | 80 | 90 | 79 | 70 |
| 1103041 | 34 | 23 | 61 | 35 |

*Group has only 1 animal

TABLE 34

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 36 | 47 | 81 | 44 |
| 1101736 | 33 | 32 | 61 | 38 |
| 1102060 | 57 | 53 | 82 | 56† |
| 1102106 | 50 | 64 | 78 | 62 |
| 1102134 | 94 | 94 | 98 | 100 |
| 1102334 | 77 | 66 | 85 | 71 |
| 1102374 | 61 | 69 | 104 | 66 |
| 1102567 | 68 | 67 | 81 | 66 |
| 1102695 | 52 | 71 | 88 | 63 |
| 1102758 | 59 | 52 | 78 | 55 |
| 1102779 | 39 | 50 | 86 | 48 |
| 1102805 | 70 | 71 | 84† | 75 |
| 1102898 | 63 | 71 | 73† | 70 |
| 1103000 | 71 | 82 | 100 | 77 |
| 1103006 | 72 | 63 | 85 | 72 |
| 1103072 | 75 | 73 | 86 | 66 |

†Average of 2 PCR points

TABLE 35

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 28 | 43 | 76 | 32 |
| 1101974 | 13 | 10 | 48 | 15 |
| 1102130 | 21 | 29 | 73 | 23 |
| 1102132 | 86 | 70 | 91 | 70 |
| 1102133 | 85 | 86 | 101 | 85 |

TABLE 36

| Reduction of human ATXN3 RNA in transgenic mice | | | | |
|---|---|---|---|---|
| | hATXN3 Expression (% control) | | | |
| Compound Number | Spinal cord | Cortex | Cerebellum | Brain Stem |
| 650528 | 40 | 33 | 78 | 44 |
| 1101657 | 28 | 22 | 66 | 32 |
| 1102028 | 33 | 28 | 63 | 30 |
| 1102637 | 40 | 27 | 69 | 42 |
| 1102638 | 39 | 29 | 95 | 43 |
| 1102639 | 34 | 31 | 121 | 37 |
| 1102640 | 56 | 58 | 75 | 57 |
| 1102642 | 67 | 64 | 87 | 65 |

TABLE 37

| Reduction of human ATXN3 RNA in transgenic mice | | | | |
|---|---|---|---|---|
| | hATXN3 Expression (% control) | | | |
| Compound Number | Spinal cord | caudal cortex | Cerebellum | Brain Stem |
| 650528 | 28 | 49 | 68 | 40 |
| 1100723 | 40† | 60 | 62 | 53 |
| 1100724 | 45 | 43 | 69 | 52 |
| 1100725 | 28 | 39 | 60 | 34 |
| 1100726 | 57 | 79 | 67 | 60 |
| 1100727 | 58 | 51 | 80 | 57 |
| 1100728 | 38 | 45 | 67 | 50 |
| 1100729 | 37 | 39 | 63 | 48 |
| 1102683 | 31 | 23 | 55 | 27 |

†Average of 2 PCR points

TABLE 38

| Reduction of human ATXN3 RNA in transgenic mice | | | | |
|---|---|---|---|---|
| | hATXN3 Expression (% control) | | | |
| Compound Number | Spinal cord | caudal cortex | Cerebellum | Brain Stem |
| 650528 | 38 | 39 | 80 | 31 |
| 1102574 | 32 | 41 | 70 | 34 |
| 1102595 | 102 | 94 | 98† | 72 |
| 1102596 | 103 | 91 | 97 | 92 |
| 1102597 | 89 | 94 | 96 | 78 |
| 1102598 | 39 | 28 | 62 | 35 |
| 1102599 | 40 | 54 | 78 | 34 |
| 1102600 | 37 | 53 | 75 | 33 |
| 1102601 | 50 | 58 | 80 | 43 |
| 1102602 | 70 | 73 | 95 | 60 |
| 1102603 | 94 | 101 | 97 | 84 |
| 1102604 | 108 | 101 | 108 | 80 |
| 1102605 | 102 | 103 | 106 | 82 |

†Average of 2 PCR points

TABLE 39

| Reduction of human ATXN3 RNA in transgenic mice | | | | |
|---|---|---|---|---|
| | hATXN3 Expression (% control) | | | |
| Compound Number | Spinal cord | caudal cortex | Cerebellum | Brain Stem |
| 650528 | 39 | 46 | 39 | 54† |
| 1100505 | 46 | 55 | 41 | 49 |
| 1100506 | 57 | 60 | 37 | 62 |
| 1100672 | 37 | 36 | 46 | 32 |

TABLE 39-continued

| Reduction of human ATXN3 RNA in transgenic mice | | | | |
|---|---|---|---|---|
| | hATXN3 Expression (% control) | | | |
| Compound Number | Spinal cord | caudal cortex | Cerebellum | Brain Stem |
| 1100731 | 35 | 33 | 32 | 33 |
| 1102811 | 19 | 24 | 29 | 23 |
| 1103041 | 36 | 26 | 37 | 29 |

†Average of 2 PCR points

Example 7: Effect of 5-10-5 MOE Gapmers with Mixed Internucleoside Linkages on Human ATXN3 In Vitro, Multiple Doses Modified oligonucleotides selected from the examples above were tested at various doses in A431 cells by free uptake. Also tested was comparator Compound No. 650528, a 5-8-5 MOE gapmer with mixed PO/PS internucleoside linkages complementary to human ATXN3, described hereinabove and in WO 2018/089805.

Cells were plated at a density of 10,000 cells per well, and treated with 109.4 nM, 437.5 nM, 1,750.0 nM, and 7,000.0 nM concentrations of modified oligonucleotide, as specified in the tables below. After a treatment period of approximately 48 hours, total RNA was isolated from the cells and ATXN3 RNA levels were measured by RT-qPCR. Human ATXN3 primer probe set RTS38920 (described hereinabove in Example 1) was used to measure RNA levels. ATXN3 RNA levels were adjusted according to total RNA content, as measured by RiboGreen®. In addition, ATXN3 RNA levels were also normalized to human GAPDH levels measured by human GAPDH primer-probe set RTS104 (forward sequence GAAGGTGAAGGTCGGAGTC, designated herein as SEQ ID NO: 2804; reverse sequence GAAGATGGTGATGGGATTTC, designated herein as SEQ ID NO: 2805; probe sequence CAAGCTTCCCGTTCTCAGCC, designated herein as SEQ ID: 2806). Results are presented in the table below as percent ATXN3 RNA levels relative to untreated control cells. $IC_{50}$ was calculated using the "log(inhibitor) vs. normalized response—variable slope" formula using Prism7.01 software. In some cases, an $IC_{50}$ could not be reliably calculated and the data point is marked as "N.C.".

TABLE 40

| Dose-dependent reduction of human ATXN3 RNA by modified oligonucleotides | | | | | |
|---|---|---|---|---|---|
| | ATXN3 level (% control) normalized to ribogreen | | | | |
| Compound Number | 109.4 nM | 437.5 nM | 1,750.0 nM | 7000.0 nM | $IC_{50}$ (μM) |
| 650528 | 84 | 67 | 48 | 38 | 2.03 |
| 1100673 | 50 | 21 | 11 | 9 | 0.10 |
| 1100914 | 26 | 12 | 7 | 5 | <0.10 |
| 1101657 | 93 | 53 | 31 | 17 | 0.69 |
| 1102130 | 85 | 46 | 24 | 13 | 0.47 |

Example 8: Tolerability of Modified Oligonucleotides Complementary to Human ATXN3 in Rats, 3 mg Dose Modified oligonucleotides described above were tested in rats to assess the tolerability of the oligonucleotides. Sprague Dawley rats each received a single intrathecal (IT) dose of 3 mg of oligonucleotide listed in the table below. Each treatment group consisted of 4 rats. A group of four rats received PBS as a negative control. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed. After each of the 7 body parts were evaluated, the sub-scores were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Results are presented as the average score for each treatment group. A comparator compound, 650528, a 5-8-5 MOE gapmer with mixed PO/PS internucleoside linkages complementary to human ATXN3 described hereinabove and in WO 2018/089805 was also tested.

TABLE 41

| Tolerability scores in rats at 3 mg dose | |
|---|---|
| Compound Number | 3 hour FOB |
| PBS | 0.00 |
| 1100397 | 1.50 |
| 1100405 | 1.50 |
| 1100406 | 1.25 |
| 1100407 | 2.75 |
| 1100528 | 1.50 |
| 1100534 | 2.75 |
| 1100535 | 3.75 |
| 1100540 | 3.00 |
| 1100542 | 1.00 |
| 1100566 | 3.00 |
| 1100585 | 0.25 |
| 1100590 | 2.50 |
| 1100725 | 3.00 |
| 1100873 | 1.50 |
| 1100914 | 3.25 |
| 1100915 | 5.50 |
| 1100920 | 2.25 |
| 1100990 | 4.50 |
| 1100991 | 3.75 |

TABLE 42

| Tolerability scores in rats at 3 mg dose | |
|---|---|
| Compound Number | 3 hour FOB |
| PBS | 0.00 |
| 1101101 | 4.50 |
| 1101339 | 5.75 |
| 1101351 | 2.25 |
| 1101974 | 2.25 |
| 1101975 | 1.75 |
| 1102024 | 2.00 |
| 1102028 | 0.75 |
| 1102050 | 5.00 |
| 1102130 | 2.00 |
| 1102131 | 2.00 |

TABLE 43

| Tolerability scores in rats at 3 mg dose | |
|---|---|
| Compound Number | 3 hour FOB |
| PBS | 0.00 |
| 1102336 | 2.25 |
| 1102353 | 1.75 |
| 1102551 | 3.00 |
| 1102557 | 2.75 |
| 1102574 | 3.00 |
| 1102580 | 1.75 |
| 1102599 | 0.75 |
| 1102657 | 1.00 |
| 1102811 | 2.00 |
| 1102970 | 3.00 |
| 1102977 | 0.75 |
| 1102978 | 1.50 |
| 1102979 | 1.50 |
| 1103103 | 3.25 |

TABLE 44

| Tolerability scores in rats at 3 mg dose | |
|---|---|
| Compound Number | 3 hour FOB |
| PBS | 0.00 |
| 1100379 | 1.50 |
| 1100398 | 2.00 |
| 1100399 | 2.75 |
| 1100408 | 4.00 |
| 1100409 | 2.50 |
| 1100521 | 4.00 |
| 1100527 | 2.00 |
| 1100536 | 4.50 |
| 1100541 | 6.00 |
| 1100544 | 3.00 |
| 1100839 | 3.00 |
| 1101000 | 4.00 |
| 1101920 | 1.75 |
| 1102329 | 3.25 |
| 1102666 | 3.00 |

TABLE 45

| Tolerability scores in rats at 3 mg dose | |
|---|---|
| Compound Number | 3 hour FOB |
| PBS | 0.00 |
| 1100571 | 1.50 |
| 1100572 | 1.25 |
| 1100667 | 0.00 |
| 1100730 | 3.25 |
| 1100732 | 3.25 |
| 1100809 | 1.25 |
| 1100864 | 3.25 |
| 1100865 | 2.75 |
| 1100907 | 3.25 |
| 1100911 | 0.50 |
| 1100980 | 4.00 |
| 1101054 | 4.00 |
| 1101065 | 2.75 |

TABLE 46

| Tolerability scores in rats at 3 mg dose | |
|---|---|
| Compound Number | 3 hour FOB |
| PBS | 0.00 |
| 1101121 | 2.25 |
| 1101122 | 3.25 |
| 1101350 | 4.00 |
| 1101352 | 3.25 |
| 1101411 | 1.00 |
| 1101657 | 0.25 |
| 1102084 | 2.50 |
| 1102090 | 2.50 |
| 1102128 | 2.75 |
| 1102198 | 3.00 |
| 1102562 | 2.00 |
| 1102563 | 3.50 |
| 1102612 | 2.25 |
| 1102667 | 1.75 |

TABLE 47

| Tolerability scores in rats at 3 mg dose | |
|---|---|
| Compound Number | 3 hour FOB |
| PBS | 0.00 |
| 1100410 | 3.50 |
| 1100468 | 0.25 |
| 1100557 | 1.00 |
| 1102541 | 0.75 |
| 1102600 | 0.50 |
| 1102637 | 0.00 |
| 1102677 | 4.00 |
| 1102683 | 0.25 |
| 1102725 | 0.50 |
| 1102980 | 1.25 |
| 1103001 | 2.75 |
| 1103014 | 0.50 |
| 1103069 | 1.00 |

TABLE 48

| Tolerability scores in rats at 3 mg dose | |
|---|---|
| Compound Number | 3 hour FOB |
| PBS | 0.50 |
| 1100584 | 0.25 |
| 1100697 | 0.25 |
| 1100753 | 0.00 |
| 1100810 | 1.75 |
| 1100872 | 1.50 |
| 1100898 | 2.00 |
| 1100900 | 1.00 |
| 1100902 | 0.25 |
| 1100921 | 0.50 |
| 1100992 | 0.00 |
| 1101099 | 3.25 |
| 1101120 | 2.00 |
| 1101203 | 1.50 |
| 1101918 | 1.00 |

TABLE 49

| Tolerability scores in rats at 3 mg dose | |
|---|---|
| Compound Number | 3 hour FOB |
| PBS | 0.00 |
| 1100559 | 0.25 |
| 1101053 | 0.00 |
| 1101202 | 0.00 |
| 1101383 | 0.25 |
| 1101659 | 0.00 |
| 1101873 | 0.75 |
| 1102052 | 0.00 |
| 1102103 | 0.25 |
| 1102108 | 0.00 |
| 1102129 | 0.25 |
| 1102180 | 0.00 |
| 1102202 | 0.00 |
| 1102239 | 0.00 |
| 1102678 | 0.00 |
| 1102998 | 2.00 |

TABLE 50

| Tolerability scores in rats at 3 mg dose | |
|---|---|
| Compound Number | 3 hour FOB |
| PBS | 0.00 |
| 650528 | 0.50 |
| 1100429 | 0.00 |
| 1100430 | 0.00 |
| 1100434 | 0.25 |
| 1100666 | 0.25 |
| 1100756 | 0.00 |
| 1100802 | 0.50 |
| 1100863 | 0.00 |
| 1100906 | 0.25 |
| 1102379 | 0.50 |
| 1102598 | 1.75 |
| 1102646 | 0.00 |
| 1102663 | 0.00 |
| 1102669 | 0.00 |
| 1102679 | 0.00 |
| 1102750 | 0.00 |

TABLE 51

| Tolerability scores in rats at 3 mg dose | |
|---|---|
| Compound Number | 3 hour FOB |
| PBS | 0.00 |
| 1100369 | 4.00 |
| 1100479 | 5.00 |
| 1100505 | 6.00 |
| 1100508 | 6.00 |
| 1101375 | 3.00 |
| 1101721 | 5.75 |
| 1101853 | 4.00 |
| 1102690 | 1.25 |
| 1102706 | 4.50 |
| 1102808 | 5.00 |
| 1103041 | 4.75 |

TABLE 52

| Tolerability scores in rats at 3 mg dose | |
|---|---|
| Compound Number | 3 hour FOB |
| PBS | 0.00 |
| 1100505 | 5.00 |
| 1100506 | 2.25 |
| 1100729 | 2.25 |

TABLE 53

| Tolerability scores in rats at 3 mg dose | |
|---|---|
| Compound Number | 3 hour FOB |
| PBS | 0.00 |
| 1100672 | 0.00 |
| 1100731 | 3.00 |

TABLE 54

| Tolerability scores in rats at 3 mg dose | |
|---|---|
| Compound Number | 3 hour FOB |
| PBS | 0.25 |
| 1100731 | 4.00 |

TABLE 55

| Tolerability scores in rats at 3 mg dose | |
|---|---|
| Compound Number | 3 hour FOB |
| PBS | 0.00 |
| 1100723 | 0.50 |
| 1100724 | 2.25 |
| 1100728 | 0.75 |

TABLE 56

| Tolerability scores in rats at 3 mg dose | |
|---|---|
| Compound Number | 3 hour FOB |
| PBS | 0.00 |
| 1100673 | 0.00 |

Example 9: Activity of Modified Oligonucleotides Complementary to Human ATXN3 in Transgenic Mice, Multiple Dose Modified oligonucleotides described above were tested in the ATXN3 YAC transgenic mouse model which contains the full-length human ATXN3 disease gene harboring an expanded CAG repeat ($CAG_{84}$, Q84) previously described herein.

The ATXN3 transgenic mice were divided into groups of 4 mice each. Mice in each group were given a single ICV bolus of oligonucleotide at a dose of 10 µg, 30 µg, 100 µg, 300 µg, or 700 µg, and sacrificed two weeks later. A group of 3-4 mice was injected with PBS and served as the control group to which oligonucleotide-treated groups were compared. After two weeks, mice were sacrificed, and RNA was extracted from brain cortex, spinal cord, brain stem and/or cerebellum for real-time PCR analysis of measurement of RNA expression of ATXN3 using primer probe set RTS43981. Results are presented as percent change of RNA, relative to PBS control, normalized to mouse cyclophilin A measured using mouse primer probe set m_cyclo24 as previously described herein. As shown in the tables below, human ATXN3 RNA was reduced in various tissues. $ED_{50}$ was calculated for the compounds using the "non-linear fit of transform ED50" fonnula in GraphPad Prism 7.01. In some cases, $ED_{50}$ could not be reliably calculated and is represented as "N.C." (not calculated).

TABLE 57

Reduction of human ATXN3 RNA in transgenic mice

| | | Spinal Cord | | Cortex | | Brain Stem | | Cerebellum | |
|---|---|---|---|---|---|---|---|---|---|
| Compound Number | Dose (μg) | hATXN3 Expression (% control) | $ED_{50}$ (μg) | hATXN3 Expression (% control) | $ED_{50}$ (μg) | hATXN3 Expression (% control) | $ED_{50}$ (μg) | hATXN3 Expression (% control) | $ED_{50}$ (μg) |
| 1100673 | 10 | 72 | 16.3 | 83 | 62.9 | 88 | 33.6 | 78 | N.C. |
| | 30 | 39 | | 76 | | 58 | | 76 | |
| | 100 | 23 | | 47 | | 34 | | 65 | |
| | 300 | 14 | | 15 | | 20 | | 50 | |
| | 700 | 12 | | 11 | | 17 | | 42 | |
| 1101657 | 10 | 71 | 25.3 | 93 | 69.9 | 91 | 79.4 | 94 | N.C. |
| | 30 | 57 | | 76 | | 81 | | 77 | |
| | 100 | 36 | | 45 | | 51 | | 77 | |
| | 300 | 19 | | 23 | | 28 | | 49 | |
| | 700 | 19 | | 17 | | 25 | | 44 | |
| 1102598 | 10 | 74 | 28.0 | 91 | 65.0 | 108 | 113.9 | 98 | N.C. |
| | 30 | 53 | | 63 | | 71 | | 69 | |
| | 100 | 41 | | 55 | | 60 | | 69 | |
| | 300 | 30 | | 24 | | 39 | | 59 | |
| | 700 | 23 | | 18 | | 32 | | 45 | |
| 1102811 | 10 | 76 | 24.7 | 90 | 80.4 | 93 | 49.5 | 92 | N.C. |
| | 30 | 47 | | 74 | | 67 | | 75 | |
| | 100 | 30 | | 51 | | 41 | | 66 | |
| | 300 | 17 | | 31 | | 25 | | 67 | |
| | 700 | 11 | | 16 | | 18 | | 62 | |

TABLE 58

Reduction of human ATXN3 RNA in transgenic mice

| | | Spinal Cord | | Cortex | | Brain Stem | |
|---|---|---|---|---|---|---|---|
| Compound Number | Dose (ug) | hATXN3 Expression (% control) | $ED_{50}$ (μg) | hATXN3 Expression (% control) | $ED_{50}$ (μg) | hATXN3 Expression (% control) | $ED_{50}$ (μg) |
| 1102130 | 10 | 69 | 21.0 | 76 | 28.6 | 78 | 33.2 |
| | 30 | 54 | | 51 | | 58 | |
| | 100 | 31 | | 37 | | 36 | |
| | 300 | 24 | | 14 | | 33 | |
| | 700 | 18 | | 9 | | 23 | |

Example 10: Effect of Modified Oligonucleotides Complementary to Human ATXN3 in Cynomolgus Monkeys Following Repeat-Dose Intrathecal Injection, 13-Week Study Cynomolgus monkeys are treated with modified oligonucleotides to determine the local and systemic tolerability and pharmacokinetics at 1 dose level, following 3 intrathecal lumbar bolus injections administered 4 weeks apart. Cynomolgus monkeys in groups of 4 are treated with either artificial CSF or modified oligonucleotide. Tissues are collected 1 week after the final injection.

Assessment of tolerability is based on clinical observations, body weights, food consumption, physical and neurological examinations including sensorimotor reflexes, cerebral reflexes and spinal reflexes, coagulation, hematology, clinical chemistry (blood and cerebral spinal fluid (CSF)), cell count, and anatomic pathology evaluations. Complete necropsies are performed with a recording of any macroscopic abnormality. Organ weights are taken and microscopic examinations are conducted. Blood was collected for complement analysis. In addition, blood, CSF, and tissues (at necropsy) are collected for toxicokinetic evaluations.

Activity of modified oligonucleotides is analyzed in brain and spinal cord tissue by measuring cynomolgus monkey ATXN3 RNA. Brain and spinal cord samples are collected and flash frozen in liquid nitrogen and stored frozen (−60° C. to −90° C.). At time of sampling, 2 mm biopsy punches are used to collect samples from frozen tissues for RNA analysis. Punches are taken from multiple brain and spinal cord regions.

Example 11. Human Clinical Trial with Modified Oligonucleotides Complementary to Human ATXN3

Ascending doses of modified oligonucleotide are evaluated in a randomized, double-blind study to evaluate the safety, tolerability, pharmacokinetics and pharmacodynamics, and clinical efficacy in patients with confirmed genetic mutation in SCA3. Patient safety will be monitored closely during the study. Safety and tolerability evaluations include: physical examination and standard neurological assessment, vital signs, ECG, AEs and concomitant medications, Columbia Suicide Severity Rating Scale (C-SSRS), CSF safety labs, plasma laboratory tests, urinalysis, and neuroimaging studies.

complementary to an equal length portion of nucleobases 34440-34486 of SEQ ID NO: 2.

2. The oligomeric compound of claim 1, consisting of a single-stranded modified oligonucleotide.

3. The oligomeric compound of claim 1, wherein at least one internucleoside linkage of the modified oligonucleotide is a modified internucleoside linkage.

4. The oligomeric compound of claim 3, wherein the modified internucleoside linkage is a phosphorothioate internucleoside linkage.

5. The oligomeric compound of claim 1, wherein each internucleoside linkage of the modified oligonucleotide is a modified internucleoside linkage.

6. The oligomeric compound of claim 5, wherein the modified internucleoside linkage is a phosphorothioate internucleoside linkage.

7. The oligomeric compound of claim 1, wherein at least one internucleoside linkage of the modified oligonucleotide is a phosphodiester internucleoside linkage.

8. The oligomeric compound of claim 1, wherein each internucleoside linkage of the modified oligonucleotide is either a phosphodiester internucleoside linkage or a phosphorothioate internucleoside linkage.

9. The oligomeric compound of claim 1, wherein at least one nucleobase of the modified oligonucleotide comprises a modified nucleobase.

10. The oligomeric compound of claim 9, wherein the modified nucleobase is a 5-methylcytosine.

11. The oligomeric compound of claim 1, wherein the modified oligonucleotide comprises at least one modified nucleoside comprising a modified sugar moiety.

12. The oligomeric compound of claim 11, wherein the modified sugar moiety comprises a bicyclic sugar moiety.

13. The oligomeric compound of claim 12, wherein the bicyclic sugar moiety has a 2'-4' bridge, wherein the 2'-4' bridge is selected from $—O—CH_2—$; and $—O—CH(CH_3)—$.

14. The oligomeric compound of claim 1, wherein the modified oligonucleotide comprises at least one modified nucleoside comprising a non-bicyclic sugar moiety.

15. The oligomeric compound of claim 14, wherein the non-bicyclic sugar moiety comprises a 2'-MOE or 2'-OMe.

16. The oligomeric compound of claim 1, wherein the modified oligonucleotide comprises at least one modified nucleoside comprising a sugar surrogate.

17. The oligomeric compound of claim 16, wherein the sugar surrogate is selected from morpholino and PNA.

---

SEQUENCE LISTING (2809 sequences)

SEQ ID NO: 1 - RNA, 6923 nt, Homo sapiens
  source 1..6923: mol_type = mRNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 2 - DNA, 54000 bp, Homo sapiens
  source 1..54000: mol_type = genomic DNA
attaattcatttgaaagacatcaactacaatttaaaaaaacaaaacaaaaacagaaaaggtggtttgcaatttttttcacttcatgagactataatttatttccctgggtaggccacacaaatccttaagaacatggactttcccccatacaaggctgtgaaccgtgcacacagagatgctcgataaatggtaccgaatcctctccttcagcacctggtcctctctggcagtctccattctcttacctctcactgccccctctacttctctgaacctgcagtccccaaagtcaccaatggtctccatagcaacaaaatttagtgggctcttatacgaccttatattgcttgacttcttggcagcaactgacactgactaccccttgaagcatcccctgcccaggccttccacaatgtcacactctcttgcttctcctccctcctccttggttattgcttctcctatcctcacggctcagctctagccctcttctcaatcacttccttttccctaaaatgattttattcactcctatggtttcagttacttttttttttttttttttttgagacacagtttcactctgttgtccaggctggagtgcaatagcacgatcttggctcactgcaacctctacctcccggttcaagtgattctcctgcctcagcctcctgagtagctgggattataggcatgagccaccacgcccggctaatttttgtatttttgtagagatgaggtttcaccatgttggccagcctggtcttgaactcctggcctcaagagatctgcctgcctcagcctcccaaagtgctgggattacaggcatgcaccaccacaatggccttagctatctgttttttaatgacaattcctcattgagttcaaagcagcctcctgaacttcagactcggtatccaaccattactcaacataattactcaaatgtccatagatatttcaaattcagtatctccaaaatgtaaactctatcttattctcttcccaaaaccttgctgctcctcccatgtttctgctctcaataccactcctgccacagtggctgcccaggtcacaaacccagaagtcaccttcacatttctgtctcctaccttccccaatccctcattgtggtaggagttattaagaaattattttaggcagatagagaggaaaaggggtccttgaaaagtttttgtctcttttgaagcagctcctgagacgtttcctgtctagcataaaagccctgacttttagacccgagctggcaacgtttgatatgcaaatgccggcagttagaaactgggtccaccaacacggtgattcccaccatcgtcctcttgcccttgttctcacaagtgcctggcaacatggccacccccacatatccccacatgagtagaacatcatagcgccctgcatttgcatattaaaaggctagggtggaatggccagttttattagggggctacatgaatgacatgcgtggtcaaaccagtcccctgagccctatgcaaatcagacaccgcctcctgcatcctcctcctataactggctggtatctcccacgcactctgggtctcctctctcagctttggagcacccatccctctgtctctgtacaggggagctgcttctttctttcttctcccttccttcttgcttattaaactctccgctccttaaaaccactccacgtttgtccatgtcgttttatgtaattcgactcaagacgaaaaaggctagtattcctccactcggtatcatcaccacattctgttgagtctctttacgtccaaagaatctctcaaaatgggctatttccatctttaagacactctcttaaaccaccatcgtctctcccaagattccttcaacagcaactgcttttttctgcagccagtgatctttctaaaaggcaaacatgaccacatgtcttcttttaaaatatttatatagctccccacatcctttaaaaggtacactttggccaggtgcggtggctcacgcctgtaattccaggactttgggaggccaaggcaggtggatcacctgaggctgggggttcgagaccagcctggccaacatggtacaacctcttctctactaagaatacaaaaatagttggacttcgtggtgcacgcctgtaatcccagctgtttgggaggctgaggcaagagaatcacttgaacccaggaagcagaagttgcagtgagcggggagattgtgccactgcactccagcctgggggacagagagagggccgtctcaaaaaaaaaaaaaaaaaaagtacaccttaatctggtttcaaggtgcaagatctgcacctatccttccatttaagtttcatcaaaccgctgctacctccccgtctcccacacaatttatgggacttctaagttccctctaaagggtccgaacacctacactggtaacaagccacctggatttgaatcctggcaagacaacttactatctgaccttggacattgtgctgttcttaacctctccgtgcctcggtttcctcatgtgtatgaataacatcaacacctacatcaaagtttgctgtattaaatttgataatatatgcaaagcatttagaaaagtgcctagctcatagaaagccttatgtaaatattaactatcattttttttcttttttggggtggtgggggaggggtttcgcttttgttgcccaggctggcgtgcaatggcacgatctcggctcaccacaacctcggcctcccgggttcaagcgattctcctgcctcagcctcccgagtacctgggattacaggcatgcaccaccacgcccgggtaattttgtatttttagtggagacggggtttctccatgttggtcaggctgatctcaaactcccgacctcaggtgatccgcccgcctcggcctcccaaagtgctgggattacaagcgtgaagcacctcgcccggcctagctatcatttttatacaagtgctgggttttgggagaatgtaatgatggcttttttcttactaaactttcagtgcaggaggaggagaaagaaagtaaatagttatatgaacacagtagaaagtcaaagtggaaaacaaaaagaacatagaacccaggtgagcggtccagacctccccccagaaacctaagaatccatagaaatgggtgggaagcggagaagatcctccagacagcaggtggcgatgtagcatcccccagaaggcccgctaacagaagctaggaggacgcgctaccaaggtcacgtgtccccggcgttcactcgctcttcgcttcacgacactcgcatcctcacgggtgattggtctgcgtgcggcacgtgggcggggtaccggggcgggccggggaggggcggggtgggcggaggagaggggcagggggcggagctggagggggtggttcggcgtgggggccgttggctccagacaaataaacatggagtccatcttccacgagaaagtgagtgtccgcgttcggtggggagctgtctgccgcgcggtggcgggcgtggagcgcggcatcaccgcctctcggagggctgggtggggcccgagtcgcccccatgccgatctcgcccggcgaggggcgacgccgcagcctcccgcctcctcggctcgaggaggggagcatcacctacgcccctacttcccccgcggcccccgccctgggagccgggagggagtatgggcggggccgggggcgtctcgggacacgggagtggggtggcgcccagtgggtttgcttctgcctttctccgtcactttccatcgcttttcggaggattccttcacccctccccaatccttccctctccctagggtctagctagagtcatctctgggacacctccctcaacccctcctaccctaatcctggcagaattaacttttcctcctccggactgctcaattctatattggagtcttccctacacgtagatctttggggtcttgttcgtgtctttcccctgcactaggtccgcgagcctcccgagggaggagaccttggctcgcccactgtagggcctgacatttaggaagtgaagtaggaaacccggcgtgcccctaaacagggaagtcgtcacaagagtttttattacgggatgtttgggtttggtttcttttggtactcccatctttccggagcaggcggccagctttgtttttaggtattaggagtggactgggatgattttgttgtagtctgcctagcctgctgtccctttaactcttccgtgaccatgcacttgaagatactgtttgtgatatgtaaagaaactcctcgtttctctcatactattatccagccatttgtgtgtgagtgaagccttccccaggacagctttggcacatggtatcatgtttcataatagtttcgtgtttggaaagagttgctggtaaggctgttatttaataggaggagcaaagggtttttgttttattaaatacttataaatgatcatttatcccagacatttaaaattcacacacacacaacaaataaagcaaagacaaaagaatacatttaccaaatgtaaatctgtagcataaattttttttaatttttattttaaagatggggtctcattctgtcacccaggcaggtgtgcaatggagagatcatggctcactgcagccttgatctcctaggcacaagcgatcctcccgcctctgcctccagagtagctgggactacaggtgcatatcgccagggccaggtaatgtttttgggagagacggggtctcgctgtgttgcccaggctggtctcgaactcctggactcaggtgattctcccacctcggcctctcgaagtgctgtgattacaggcgtgagccactgtgcctggaacaaattgttaagtacaatgcttttcattgtagaaaacatctcggaaacttttgaaataggctgatgttcagtgggggaggaaggactcagtcgtatagttgtcactaattttttgacttgattgacatgactcgtaaatcatagacaatagagatttggttgcttggctgagtagagtgcgtgaaaaatacacacgtacttttttttttttttttttgagatggagtttggctcttgtcacccaggctggagtgcaatggcgccatcatggctcactgcaacctccgcctccccgttcaagcgattctcctgcctcagtctccccagtagctgagattacaggcgcccgccaccacgcccagctaatttttgtatttttagtagagacagggtttcaccatgttggccaggctggtctccaactcctgacaggtggtccgcccgcctcggcctcccaaagtgctgggattacaggcgtgagccaccgcacccggccatatttttgttattaattttcaaaggctttggtgtgggaccacatttcaacatggaaggccttaaacatgttccacactacttcctgagaattagacaagatttttaacaatattgttacctagttgggacacatttgtactgacccatgggatgaaaaaaagctgagtgctagcctagtgaaaatctacttacccgaaagaaatccctcttagtctgggtgcagtggctcacaccagtgctttgggaggcccagacgggcggatcatgaggtcagtagtttgagaccagcctggccaacatggtgaaaccccgtctctactaaaaatacaaaaaattagccaggtgtggtggcaggcgcctgtaatcccaggtactctggaggctgaggcaggagaattgcttgaacccgagaggcagaggttgcagtgagccgagaccgtgccactgcacttcagcctgggcaacagagcgagactccgtctcaaaaaaaagaaaaggaaaaaagagtccctcttaattatcagcatgtgtataggcctacagatacttcaggaatacctttaccattatcatcaacttgtatctacatagcatgtgaagattcaacaatttagttttttgggcgtcctcaagagtacgcacctataaccatatggcccaattgttaatctcctatacagtccattctgggaatgtttgggcttactgtgccatttttccgttcactgccttcccctctgcaatatacctttaacccttgctaggtcctgggtttggagagccagagaaccaactttggccctaaagaagctgtgtaggtagcaatatctgcctacgaagggccttgcaaccatttcctcttggaaccttggtttcctctttctgagtagtcactttgagtaccctttattaagttagaatgtaaaaacagtttctcactgatatatctgcagtgcctgagagagggcctggcacagagtaagtactcaataaatatttgaatggggccgggcgtggtgagacctgtctctacaagaatgaacaaaattagctgggcgtgttagcacatgcctgtagacttgggaggctgaggtgggaggattgcatgagtctgggaggtcgaggctgtagtgagccatgatcgcaccactgcactccagcctaggggacagagcaagatcctgtctcaaaagaaaaaaatgtatatatttgaatggataaagagatggctttgagtttctgagatatatatggtgctgtttatctaaagtaaacaagttttctgtaaatattttaaggctttgcaggccagctgtagtctctgtcacacattcttatttgtgcatgtttttcccaaccatgtaaaaatgtaaagtgcattcttagctactggggcaggttgaatttggcccatgggctagagtttgccaacccctaacttaaacctttgtactaactttatgaccactactggatttttgttgttgtttgttttagttctggtgcctgctttgtttttttttttttttttaatcctcttgctgatgtttcttggtgcagttactgtgccatttgtattggtgcttttaatgtaatgcaaactggtaataatatctaaacttgctggggttgtacataaaattattgaaaagattgaaaagatgctgagcattgactctgtggcattcattatgcccttttgtgattgctggattttagccatctttaggacatttgagctttaggagaagccaaattctgtataaatgacttgaagtgctaatagcacaggttttgaaacctctgcctgggtttgagtctcagctctgccttttactacctgtgtgatcctgagcaagttacttagtatccctgtcctctagtttcctcctctgtagtgtggggataataacatagacataacctgagagttagagtgtagagaaggctccctggcagatagtgctgtagaagtactggccattgccattactcaggtgcttgtgtttgctgaacctcatagtaagggctcggagagcactaagaggaggtgagaaatgctgctagattgacagcttgtccccagatagcccattcccgagagcaccttaggtttatacctgatttgtgttgtagttagtagtgtctctggtaatttgaactagtttcaggttggtcttgaaaacctggggaggttgggggtaaatgatttggtagcagttctcttttgtgattttatacattatctttgtagaactgcagtttgctaattctctgagcccaacacaatgaagtctgggcctaaaatcatagaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggctggagtgcagtggcgcgaactcagctcactgcaacctccgtctcctgagttcaagagattctcctgcctcagcctcccgagtagctgggactataggcatgtgccaccatgcccagctaattttcttatttttagtagagacgaggtttcaccatgttggccaggatggtcttgatctcttgacctcgtgatccacctgcctcagcctcccaaagtgcggggattacaggcgtgagctaccacgcccagcctattttttattttttgaggcagagtctcactctgtcacccaggctggagtgcagtggtgcaatctcagctcactgcaacctccgcctcctgggttcaggtgattctcctgccttagcctcctgagcacctgggactacaggcgcctgccaccacacctggctaattcttatatttttagtagaggcggggtttcaccatgttggccaggctggtctcgaactcctgatctcaagtgatcaacctgccttggcctcccaaagtgctggaattacagccatgagccaccatgcccagccaaatcatgagatttcaataccgctgaactttgattatggcaaagtgaacttctgctttgattaaagcttgatgagagaggtggctggggatagtttgagataagggcaaggcaggaaaatgcataatcttacgtgggctcattgtcattgtacaattcttttggtccatgtggaatttgatccgtcctatgacttaagttatgtttatttttgtttttatttttatttattttgtgtctttttgagagacatgatgttgctctgtcacctgggccagaatacagtggcacaatcttagctccgtgtagccttgaactcctgggctcaagtgatcctcccacctcagcccctcaaacagttgagattatagtatgaaccactgtgcctagccttaagtgatttttaaatttgtactgaacagtttgtcctttccttccattaaatcatattagaagtacagaacttgatatttcctgtagcaatacagtttttctttgatgaagtttgatttcaagtacttatttttcataatttaaagctattttttatagagagaattttaatcaaatatttggatgtcactattgctatatatggtattaagtatggtgaccatagtttgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagtgtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactgtgatcccagctatccatttgggtcgtttccagtttggggtccattacaaatagtaatgctatctgtaatgctattttgtattactacaaatagtaatgctatttgtggcacaaaaatactgcttttgtgaacattcttatacatgtcttttgatgaatgtatgtttgcattgctgttgtttacattatgtacctagtaatggaattgctagatcataggagatgtatatattaagctttagtggatgcattacataattattagttattattggttataccaatttatcctctcatcagtagtatacaacagtttctgtatctctaatctccaacattttagccattttagagtttgtgtactaacacattgtggttttaatttacatttccctgatgactaataaagttgagtacctcttttgtgttctttatagccatttgactgtcttgtgaagtgcttgtttgtcttgcctatttttcttttctttctttctttttcttccttccttcctttctttctttcttctttctttccttccttcttttctttctttctgtctttctttcttgtctttcttgtctttctgtctttcttggtcttgccctgtcacccatgctggagtgcagtggtgcagtctcagcttactgtagcctcgacctttttggggctcaagttatcctcctttctcagcctcccaagaagctggactacaagcacgcaccaccatgctcagttaattttttattttttgtagaaatggggtttcaccatgttgtccaggctggtctcaaacttctgggctcaagtaatcctcctgccttggcctcccaaaatgctgggattacaggcatgagccaccgcagccagccttggctatttttcaaaaggatataagtagaacatctgtatatcccttcaatttgcatattattcagtaagagttgcactctggtagtagaaatatataaggaggagaaagaagtggaaacaaaaagtctattctcatgagaagacttgggggatagtgttctctctagctccaagctacttattccttacgaaaagttgaagataaacttatctcagactgaggctgtctcaatgttgtcttcctattccattatacacatataacccatatttttttcaccagctgaattttgctcctagaaaattgattcatcaggaaaaatatccgtcttgcaaggtggttctctttagagtctgctgtgtgacatagctcaggacaaattgtgtgatgtcagataggttgggttaaggaatagaccttattggggaaagagagaacttggagggccaaggttagcaggagaaggaaatgttctctcatctgccgtcaattcagggaggggcaaacctggtgtctgtgttcacagggagggatccatccatctgtgattctcccttcttatcaggtagcatgggaaagctacactgttgcggggaggagggtcacacgcaggctacttagtaccaggcaccctggacttggattcaggttgccagttgtgtgagaaactgcccagcacctgaaggccctgaacccatgagaagttgtacctacctcccatgaggaggaatcctgtcatcccatgggagctgagcttgggtgcagtccctcttgctggcttgtccaggagtgagctccagggttgtttgggacagttctgctcattgctttacactgtgtatacattatctgtagagttccatgaagagaacttcagcactgtaactgcaagttttaacatggaacagaatttttctcacctgtattaattcttaagatttgaagttctatcaacaagcatttagattgtgtggagatttttttatttttatttttggagacagagtcttgctctgttacccagactggagtggcagtggcatggtcttggctcactgcaggctctacttcctgggttcaagcgattctcatgcctcagtgtcctgattagctaggactacaggtacacaccaccatgctggctaatttttgtatttttagtagagacgaggtttcaccgtattggtcaggctggtctcgaactcccagcctcaagcagtccacccacctcggcctcccaaactgctgggattacaggtgtgagccaccatgcttgactgacatcatcatgttaaaagaataaatgttctagggagctgggcacagtgtcatgtttctgtagttctagctgctcgggaggctgaggcaggaagatcccttgagccctggagttcaagtccagcctgggcaacatagtgagatctctttttttaaataaataaataactgttctagggactaaaatttcctttcaccattagtaatttactgtagaatctccaagaatgaacttattttaggtactgaaaatgagggagactaaatgttttatacagtagtttttagtaaaatatgagatttgatgcatttgatagatgatgtttgtttaaaataattcttaaatttttgatcatgtaattatagtttcattaatggtagatttgtaaaataaatgttaccaaatgaaaatgcatgtacctatgttaattatccttatctaaagctgaaagttcagttcaactatgttaaaacatagtaggggcctggcagggtggctcttgcctgtaatcccagaacttagggaggccaaggtgggcagatcacgaggtcaggagatcgagaccatcctggctaacattgtgaaaccgtatcgctactaaaaatacaaaaaattagccgggcatggcggtgggcacctgtagtcgcagctacttggtaggctgaggcaggagaatggcgtgaactcaggaggcagagcttacagtgagccgagatcatgccactgcactccaggctgggtgacagagcaagactccatctcaaaaaaaaaaaaaaagttggccaggtgtggcggctcacacctgtaatcccagcacttttggaggccgaggcaggcggatcacaagatcaggagtttgagaccagcctggctaacagagtgaaaccctgtatatactaaaaatacaaaaattagccaggcatggtggtgcatgcctgtagtcccagctacttgagaggctgaggcaggagaatcacttgaacccgggaggcggaggttgtggtaagctgagattgctccactgcactccagcctggacaacagagcaagactctgtctcaaaaaaaaaaaaaattaatgattaaattatttaggggagccgggcgcagtggctcacgcctgtaatcccagcactttgggaggccaaggcgggcggatcacgaggtcaggagatcaagaccatcctggctaacacaggatgaaaccccgtctctactaaaaatacaaaaatttagccgggcgtggtggcgggtgcctgtagtaccagctactcgggaggctgaggcaggagaatggcatgaacccgggtggcggagcttgcagtgagccaagatagcgccactgcactccggcctgggtgaaagagtgagactccgtctcaaaaaaaaaaaaaaattatttaggggaagatactatacaattctgtttaacaagtcacattttaattttttcttttggaaatattagcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggtactgattttaaactcactaagtcacatttcttttttttttttttttttgagacggagtctcgccctgttgcccatgctggagtgcaatggcgcgatctcggctcactgcaacctctgcctcccgggttcaagcgattctcctgcctcagcctcccaagtagctgggattacaggcacacggcactatgcccggctaattttttgtatctttgttagagatggggtttcaccatgttggtcaggttggtctcaaactcctgaccttatgatccacctgtcttggcctcccaaagtgctgggattataggtgtgagccaccacacccggcttacatttcttttaaaaatgtggataccatttagaaaaggatgggccattcttcctatagggatctgactggtgaattataactgtgctgttaactttggaaatgggaatgcacaagatattgttttaaatatgcacgctaatgacagtttgtatccttctttccccacccccacccttgcttcaactacctgtcaaaattaacagcagccttctggaaatatggatgacagtggttttttctctattcaggtaagtagtcacaagcatgtactatgtgttgcttacatcccaggcaccgtttcacagcctttcaatagtcactgtaacaaggcgaccttcggaagttcttctgtctacagagtatagattatactctagagtactagattttttttttcttgagacagagtctcgttctgtcacctaggctggagtgcagtggcgtgatcttggctcactgtagcctctgcctcccgggttcaagcgatcctcctgcctcagcctcccaagtagctgggattacaggcacccgccaccacaccagttaatatttgtatttttagtagagatagtggggtttcaccgtgttggccagtctggtctccaactcctgacctcagcctcccaaagtgctgggattacaggtgtgagccactgcacctggccaactagagtactagatttttatatagataaacatgaaaggattgtagaatcttcatattagagtggggcatttaaaaattccttcttgagaaagattaatttgcatctggatgctaataataaccttaattctggccgggcgcggtggctcacacctgtaatcccagcactttggggaggccgaggtgggcggatcacgaggtcaggagattgagaccatcctggctaacatggtgaaaccccgtctctactaaaaatacaaaaattagctggacgtggtgacacgtgcctgtaatcccagctactcgggaggctgaggcaggagaatcgcttgaaccagggagtcgtaggttgcagtgagccaagatcgcgccactgcactctagcctggtgacagagcgagactccatctcaaagaaaaaaagaaatccttaattctaataagtcacaatgtctcaaacttaccatctgttgggtaaatttgagaaaatgcaataccttgctaccatccttttaaatcagcctaccagactggatttccttattatggtttgtggcttttgattttttttttttaatgtatagctctctttgaattctttggtggttatatatatatgtactcgcaagattcttttatctgtgggtctttcattctttttctaacactgtgagttgtatccagagtactttcggaacctctcctgagcgacctatctctgcagatatctttgtttatgtttcccttgtactgccctcctggactcttcctcatccaccagcatttccatctagtgctttaccgtgccactgctaacaggtaatggctactgcagggctgaaatcagaggccagagtaggcccagcacttggcgtttcctatttgtgccttgctgctcttggtgcctgttcatgtgtgcccactaccttgcactcaatttctgtctttgctggtacctggctcacttgcttctttgttggctaccttggagggcagatagtgaattttcagaaatttccctttttttgtcagacagattgaaataaacaggtttgcattttgttttttctacaagcggcaagcccatgaccctagaagtctgacatctatggaaccttcagtttaaatgcccagggagaacttattttggtagatatgatttctgacattgcaggtagcaagttgaatataatttttctaaagtagcacccacagcagccaaattatcagatgtatatagtagactagttttaagaaaagcacttatgggtagaatatacatctggatttttgaggcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggcccaggcgggtggatcacaaggtcaggagattgagaccagcctggccaacaaggtgaaaccctgtctctactaaaaatacaaaaatagctgggtgtggtggcgtgtgcttgtaatcccagctactcgggagcctcaggaggagaatcgcttgaacctgggaggcggaggttgcagcgagccgagatcgtgccactatactccagcctgggcgacagagcaagactctgtcacaaaaaaaaaaaaaaaaacctatagccttctagagaaatttatatatgaagtacacaactaacatagctacacttcctaaatttggaatggagtggtttagcttatgaaaagttgctatttttcttaacaggttataagcaatgccttgaaagtttggggtttagaactaatcctgttcaacagtccagagtatcagaggctcaggatcgatcctatgtaagattctgttttgcatttcatacatttcttttcccaaatttgatttttaaagttgtaatttcttaaagaagagaaatacattttgaatacttttgttttgatgttccctgtttcattcactcagactttcctatttcacctttgtgatgtccatgagcatctgccctgtagccttcctggcaccccagtgtctgtggcagcacagagctgaccccataagtggtgcatgaggccatcttgtggcacagcatcactaagctgctgcagagacgttcatatggttgtgtgatcttttaaaaacatcagtgacacttaactataaatataatcttaaattatcacaaattttatataatatttgccagtagacaacataaatatgaattcaatatttcaagttaatattgtctgttttcttttttagaaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttgggaggctgaggtggggggatcacttgaagccaggagtttgagaccagcctgggcaacaaagggaggtcctgtctcttaaaaaaaaaataaaaataaaaataaaaataaataaaaaaaaaaacaaagagccaggcatggtggctcacatctgtaattccagcttacttggaaggctgagtcagaaggatcacttgagctcaggagtttgaggctgcagtgaactatgattttgtcactgtaccccagcctgggtgacagagtaagactgttctataaaacataaaaataaaaaaaatatatttaaaaattaaaaaaaaaaaaggattgctgactttaaaattaggaaactgaccagtaatgtgtgtgtgtgtagcatggtttatccttcttgatagatagaaattgtcattttaaaagataatatcagttttccttataaatttatttgtgacaagtatatgcaatttaactatatcataagaaaaattctatattaaagataatacaaatgtggttacttttaagtgggtttttatgtgatgactatgttctgtcagttaattattacatttatagatttgtatttagcatagtgctgtcacaaagcctgaaatagtgtcaagcatgaataaagcattcaattatgtttgctttagtgtaagattattcattatgattccaaaagccatgtaatacgtacgtctacagaaaatcacttctattttttaaataaaacatgaaatatgtcttgagcaagctattttaagaaacaatcatttaacgtccttgttattagaattttgaatctttgaaagagggttattgaaaaccagctaggacagtaaaaaagaataaactagtgatacatgcagcaatatggatgaatctcaaaataattatgctgaaagaataacccacaaacaaaatactacctgctgtatggtatcatttattaaaagtctagaaaagtgcagattcatctgtagtgatggaaagcagattgaccagcggttgcctggggacgagaaggctatggaggagtgagaggggagggttacagagaggcacgggaaacatggcaatgaggaatgtgttcactatcttggttgtagtaatggtttcatgggagtacagtatacaaatgtgaaaacatttcagaggccagatgcagtggctcatgcctgtaatcccagcacttttggaggccaaggcaggaggattgcttgagctcaaggagttcaggaccagcctgggcaatggcacaagaccccatctctaaaaaaaaaatgaaagaaaaaaaaattggctaggcgtggtgatgcatggccgtagtcccaggtgctagggaggctgaggagggagcacagaggtcaagcctgcagtgaatcatgatcgtgctactgcactccagcttgggtgacagaaggagatcctgtctcaaaaaaaaagtttcaaattatacactttaaatatgtgcagtttattatatgtcacttataccccaataaatctgttttttttaaaatgtaaatacaagccaaaaaaggtataagtcaagaaaatatattgaattaaatctgtaagagataattcaaaaacaaaaaccctattgttatcttttaagtcacccaaatcaaatttgggaaaagtcacctacttagcttcatcctaagttggttctttctttctttctttccttcttttgagacggattcttgctctatcgcccaggctggattgcagtggcgggatcttggctccctgcaacctccgccacctgggttcaagcaattctcttgtctcagcctcccaaatagctgtgtctacagccacgcaccaccacacccagctaatttttgtatttttagtagagacggggtttcgccatgttggtcaggctggtcttgaactcctgacctcaggtgatccgtccgtctctgcctctcaaagtgctggggttacaggcgtgagccaccatgccgagccctaagttggttctttcttaaagttcttcctgaggagccaagagcaagttaaggagatgtaacctagaagcttacagtggaggctagctgggtgcagtggttcacgcctgtaatcccagcactttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttatttatgtgtttttaaaaattatgatccagtattttttacttttttttgtataaagtaagcactgaatttttaaggttgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtctaaaaaaaaaaaaaaaaaaaaaaaaagagtatttagcagaggccaggtgcagtggctcatgtttgtaatcccagaactttgggaggctgaggcgggcggatcatttgaggtcaggagtttgagaccagcctggccaatgtggcaaatgtgctgtctctaactaaaaatacaaaaattagctgggtgtggtggtgcagacctgtagtcccagctacttgggaggctgaggcaggagaatcacttgaacctgggaggcagaggttgcagtgatccgagatcatgccactgcactccagcctgggttacagagtgagactcttctcaaaaaaaaaaaaaagtatttaatagtgataaatctgcagtattctcttgtagtttttaagatcatattattcagtcaaagaaaagagctcaacttgaaatatttccagagtttaaacaatcttactaagctttgatgggttgtatctattcttaacatgtgaaacttccttattacctataatatacactaacttaaatattgacaatttttttccagtggtttaacttgaattctctcttgacgggtccagaattaatatcagatacatatcttgcacttttcttggctcaattacaacaggaaggtaagtaacggctgaacattttgtaatgttacctttcgaagtagttaaataaccaggcacattagatgacagtgtgataaaactgtttttctggcagtggcagtgaaacaatctttagttttgacgtggtgataggctgtgatttgggtgacgctgttcagttagagttctcactgacacctggcccttcctcttctgaggatgctgctttctttgcagcccttctaagtaatggctttttcttttatacatcacatatcacacggctgagaggagggatagatgtttttcttctttgcctcttctaggccactgttcttccttataaactccagtttctttgaaatacatgcccctaacggctgggcacggtggctcacgcctgtaatcccagcactttgggaggctgaggcaggcggatcacgatgtcaggagatcgagaccatcctggctaacacggtgaaatcctgtctctactaaaaataacaaaaaattagccggggtgtggtggcggacgcctgtagtccgagctactcgggaggctgaggcaggagaatggcgtgaacccaggaggcggagcttgcagtgagctgagatcgcgccactgccctccagcctgggcgacagagcgagactccgtctcaaaaaaaaaaagaaaagaaaaaaaaaagaaatacatgcccctagattaaactatcccttgtccttttgcactcatccacaagtctcttttcatcagtgattttaggatctgactcgttgtctttttctctacttcaactacttttatcattcttaattatttctgtatcgtcaatcaatccagtacctgcctcttagtttcaaaatcacttactcttgcttagctattaccagtaatcataaccactgtcaaatctcaattgcaagcatattactctttaactaccacctcctatctttaaaccatgttttgtctgtttttttattccagccattctttaaaccctactgtggggcccaagcatttcctttatacgcattcttcctttcttctactgcttattttctgtaatccgtcatcataatcactccattgcattcttcaacgtgtttcccctctctccctccatcatacttgaatgacaaaaatctcaaccctggttaaaccacatcttggccttgtccattcctgtaccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgccttagcctgttgagtagctgggactacaggcttgtgctaccacacctagctaaggttttactttaaatttattataatcacaaaattcagatgagcctttagtgctgtctgatatttctactatgttttcttagtgatgtaccaccctccaaggtgtttataaaaaattatgtaccactctccaagaagtttataaaaaataatgtgccaccctccaaggtgactaatttcacagcttatgtctttaaacctttaagcactttcctctcccttacacaccttccttgtggctttccgttacattctgctgagaacatagaagcaattaaaattatgttctttctaccagcaaatttatcaatttgcttatatcttcacctgtgctttgagcctatttaaatagatgaatggtcccctacctctaaccaaaaccagtccctcacttgtgggctggatcccagctcttctcacctactcaagatgttcctgctttcatctctccactctcttatataatcagttccccccccctttttttgtaatattcctataagcagtaaaataagctttttatttccattgattaaaaataaaaatcctctcttaattccatgaaactccagctgcctccccatttttattttttccttaggattgtctctagtgtgccttctccttttcttgaactctgcctcctgggttcaagcgattctcctgcctcaacctcccgagtagctgggattacaggcgtgcaccaccatgaccggctaattttttttttttttttttgagatggagtttccctcttgttgctccggctggagtgcaatggcgtgatctcggctcaccgtaacttctgcctcctgggttcaagcgattttcttgcctcagcctcccgagtagctggatttacaggcatgtgccaccatgcctggctaattttgtattttagtagagatggaaggggtttctccatgtttgttaggctggtctccaactcctgacctcaggtgagccgcccacctcggccccctaaagtgctgggattacaggcatgagccactgcgcctggccccggctaaattttttttttttttttttgtatttttagtagagacagggtttcaccatattggccaggttggtctcgaattcctggcctcgagtgatccacctgcctcagcctcccaaagtgctgggattacaggcgtgagtcaccttgcctagccatcttttagtaatggtatttggagatcacaatttgagtgctggcatgcttattgctgctgggtttgttatgtagttattgtgaattcacatttaggaatatagggtttttaattctttgattttagatacttgtatcttttttcttttatatttaaaaccttggttcctgatgatatcccttcttagaaaccctgtctacctttggccttcagcccaccatgctgtggttttcctaacttgctgcctgcacttttcagattcctttcatggatcttaaatatcatctgtaaataagatctatgtgtcaataattaccaaacttttatctttagtcttgacatctaccctgaacacctagctttgactaactcctagctttggcatctccacttggaaatccaaaaagtgtttcaaactgaacatgtctatgaaagacttatttttttctctctatccatgctatccatcaggttttccatttccataagggtgactcttgtactctggttcctatatattataccgacagagcagcccagagtgcttcttaaccagtgtaaggcctgttatgtcccaccctcactctttgtccttcagtggcttcccagcacacttagaataaaatctgaagtcttaggccgggcttggtggctcatgcctgcaatcccagcactttgggaggatgagggggcagatcacttgaggtcaggagttgatgagaccagcctggccaacatggtgaaaccctgtctctaccaaaaaatacaaaaattaactgggtgtggtgttgtgcacctgtagtcccagctactcgggaggctgagataggagaatcacttgaacccgggaggcagaggttacagcgagccaagatcataccactgcactccagcctgggtgacagaacgagactctcaaaaaaaaattaaaaaaaaaaaatatgtgaagtcttgaataaaacccaagatctttaccatggcccctgaacagggcagagtatccattcttcagacactcttcatagaataccatggtgagctggcatatttattatacaatacagaaacaattttactggcagaaaacacattaaaccgtctaaactctgaatacagttgtcctcataaaaaatgttcaacatactattttgaggttttccattaatagttcttataatctttgtcccattatgtgttaatccaacaaaggatatccaataacaaacaccaaagtttaagaaaaatgtgctaggcgcggtggctcacacctgtaatcccagcactttgggaggccgaggtgggcagatcacctgaggtcaggagttcgagaccagcccagccaacatggtgaaaccctgcctctcctaaaaatacaaacattaactgggtgtggtggtgggtgcctgtaatcccagctactcaggaggctgaggcaggagaatcgcttgaacctcctgggaggcagaggttgcagtgagctaatattgcaccactgcactccagcctgggtgacagagtgagactccatctcaaattaaaaaaaaaaaaaaattaatgatagagaaacttaaatcagttagattgttttaggtatagcccatccttggtttttgtgtgtagcatctagcttggggaaaccctggatttctggaatcatatttagacacagtcacactagactaatgtaattcttttgggatgcaaaccacacgtttgacaccttaaatagcttttaggtatttggcttcccagcccctatttttagttacaaggggtgtacatgtgtgggtcagggtgggggtagctctttccgcagatgattagttttagccatgttactagttattgcacacattatctgtgtcctcacagcagccctgtgagtaagtgtattagggttctctagagggacagaactaataaggtagatgtatatatgaagggtaatgtattaaggagtatcgactcgtatgatcacaaggtgaagtcccacaataggctctctgcaggctgaggaaccaggaagccagtccaagtcccaaaacctcaaaagtagggaagctgacagtgcagccttcagtctgtggcaaaaggcctgagagcccctggcaaaccactggtgtaagttcaagagtccaaaagatgaagaacttggagtctgatgtttgagggcaggaagcatccagcatgggagaaagatgaaggctcagcaagtctagtacttccacactcttatttctgcctgctttattctagctgagctggcagctgattagatggtgaccacccagtttgagggtgggtctacctctcccagttcactggcttaaatgttaatctcctttggcaacaccctcgcagacacacccagaaacaataatttgtagccttcaatccaatcaagttgataatattaaccatcacaggaaggtactagtatcatatgtttaacagtagaaaccaagacaaatgcagctaggaagtgggagaactgggatcagatgcaggcagtctgattctaaatcagttgctgttacccactctgacaacagtaagtgagtagcctgctcagtcaagtactatattagtagggccctttacagacatatttatttctcacagtcactcaatgagacggctcttccagtcttacaatggagaaagtgaggctcagagactttaagtaacttaccttagacgactttactagtaagtataagaatcattatttggactaaagtctttctgaatcctcagcttgtatttttttccagtgttctgtgctgcctttttatctactagtgttttacatcaattttgaatctctttactaactggttaggttgatttttgccttttttttttaggttattctatatttgtcgttaagggtgatctgccagattgcgaagctgaccaactcctgcagatgattagggtccaacagatgcatcgaccaaaacttattggagaagaattagcacaactaaaagagcaaaggtaaaaatgaggcctgcagtatggaatatatggtagtatttcattatgagaattaaattttcatgcttagattgaatatgtggtccttgtgttgttggcgactctattttggaccttatattttagtgaagtttattagtttaaacttgaatcaactctttgaaatacttaaatatattaacttagttagctggtatggtatattcctagcacttcgggaggctgaggcaggctgattgcttcaacccaggagttcgagaccagcctgggcaacatggcaaaacctcatctctacaaatagtacaaaaattagccagatgtggtggtgtatgcctatagtcccagctacttgggaggcagaggaagaaggatcacctgaaactggggaggtagagactacagtgagccataatcacactaccgcactccagcctggtcgagagagtcagaccctgtctcaaaaaaaaaaaaaaaaagaaacggaaaaaaaaaacttagttggattcaaattgcaacacaatcattatattactagagcttatttgccagaaaacattttaagttttgacttacttaaagcctttacattacaaatgcctttatgttatgtctaaaatagaagattggttgcagttattaccagtgcttttgttctttagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttagatttcatggaagttaatgtactcttagaggtgttttgacaattactgcagaagcaatagctatatagtgggctttccctttagatttcttataatggaaatcactttttacaacctatattttattaggagtagttatatttttactcctggttattttatttggtttcaacactgtactaacacaatagtaaattgtggttttaatctttgtgggtatcagttgacccttatccaaatcagctgttacataaatatgtgccattagacactatggaagggcctggacagggaatataaactgattttacaaaaacccaacatttattggctatgcaacttaaaccgtaagcccactttggtgggcccagttttttagtgatataaactatcaatagagaaaagcgaaaacatatcccctagacaatctaggcaaagaaaaatgttaagacatagctcaaagtagcttaattaaaagtttgaagtgggttttttgttttatttttttctaactcatatgtatttgcttctactttctaatgaaattatttatcagttgatttccttagatatctaaataaaattgaaatttcattaatgggaagattatttttatcctgaacttttcttgcctctatgcatgcctctgagtactccatatggtgtgcaatcccatttttgattaatagagtcctgctggattagcagggacagaaatcagctttagatttctttcttttttttttttctttctttttttttttttttttttttgagtcagagtctcactgtcgcccagcctggagtgcagtgatcttggctcactgcaacccctgcctccgaggttcaagcgattctcctgcctcagcctcctgagtagctgggactacaggcgcctaccaccacgcccagctaattttttgtacttttagtagagatagggttttgcccttttggccaggctggtcttgaactcctgacctcaggtgatccacctgccttggcctcccaaagtgctgggattacatgtgtgagccaccacgcccagccagaagagtagaatattcttaaagagaaaacgttttaaaggcttactcaaatgagtataaacaaacatattgttgcttgaattggtaaatacagtgattggtttttgttgtgttgtgttttgttttcaggtagttccagaaacatatctcaagatatgacacagacatcaggtacaaatcttacttcagaagagcttcggaagagacgagaagcctactttgaaaagtaaagtagttggtacaagttaaagtagcatgtttaatatttgctttggctattttgtctatttgtaaatggttactgcctgaatcctgtgaatatttgaatgtattttttaaaaatttacagcaaataggacgggcacggtggcttacgcctgtgatgctagcagtttgggaggccaaggcgggcagattgcctgaggtcaggagttcgagaccagcctgggcaacacagtgaaaccccatctctactaaaaatacaaaagaatcagctgggcatggaagcgtgcgcctgtagtcccagctgcttgggaggctgagccaggagaattgcttgaacccgggacgtggaggttgcagtgagccgagatcgcaccactgccctccagactgggtgacagagtgagactccgtctccaaaaatatatgtatatatatataaataaaaataaaaatttacggcaaataacatgaaacaaaaaaaccttgccccaatactggataaattttttaaactgagtgaaggaaaccttataaaatttcatttattaaaagaaaaatgaaattaggacaagacaagaagaatgccaattgatcctttggatgtacttcttgcttacctgattaaccctgcaaaattcctctaccaatcagtacgaaaaacagctttggaggtatgggagcgcattcccaaatagacgtggtagttcatttagctgctcatggccgcttcaggcagtcctgtaagcctgttagcatcaggggaatggatgcaaaccataaatctggatcaactcctaaaaccttaccttgtgcccagccttgtaagtgcttgctaaataggaattccaccatatgaaaatacattcttttcaagtaactatcattcagacttttgtcccccactttttttttttaaagaaaaataaaaggctgggcacggtggcttacgtctgtaatcccaccattttaggaggccaaggcaggtggatcacctgaggtcaggaattcaagaccagcctgaccaacatggtgaaacctcatctctactaaaaatacaaaaattagccgggcatggtggtgggtgcctgtaatcccagctacttgggaggctcagacaggagaatcgcttgaatctgggaggcagaagttgcagtgagctgagataacgccattgcactccagcctgggggacaagagcgagacttcgtctcaaaaaaaaagagaaagaaaacttcatgttaaagattacaagataaataatcagacccactgatcctaggtcagaaaacagagtcatagctcaatctgacttactatttgctgtatttcatccattctgagatgcacatagtttcacatttcaatgtctctgaaattgagaagcatcttacagtcataattgacagtatattagcagcacctataaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagtatagattaatggctaattatatgttaaatttcaaagtagtgcttattagtgctttttacttttaagtttcaaaattaacttttttattataataaactccaaatttatacaaaagtagaaaaactagcatactcctgtttatgacccagattcaacaaatactagcacacggccaatcttgcttttttttttttttttttttgagatggagtcttgctctgttgcccaggctggagtgcaatggcacaatttctgctcactgcaacctctgcctcctgagttcaagcgattctcccacttcagcctcccaagtagctgggattacaggtacacaccaccatgcctggctaattcttgtatttttagtagacacgggatttcaccatgtcgtccaggctggccttaaactcctgacctcaagtgatccacctgcctcggcctcccagagtgctgggattacaggcatgagccactgagcccggcccaatctcgttttataatactcccatctcccattctttccactgtcccacctgcaagtttggattattttgtaacaaatctcaatcatcatattattctataaccattttaatatgtgtctctaaaatatattagctttatttttaacatagttaaatgctattgtcataaaataataatcataataattaattgtaattctatatcatcaattatctagttaatgtaaaaaataaatctaaggccaggcgcggtggctcacacctgtaatcccagcactttgggaggctgaggtgggcagatcacctgagatcaggagttcaagaccagcctgaccaacatggagaaaccccatctctactaaaaatacaaaaaattagccaggcgtggtggcgcatgcttgtaatcccagctacttgagaggctgaggcaggagaatcacttgaacccgggaggcgaggttgcggtgagccgagatcgtgccattgcactctagcctgggcaaaaagagtgaaactccatctcaaataaataaataaataaataataaaaaataacttaaatctacttaattagaaaaactaacattctaaaaattttattttaagaaatatcaaaattggctgggcacggtggctcacgcctctaatccctgcactttggaaggctgaggtgggcggatcacctgaggtcaggagggtcaggagtacaagaccagcctggccaacatggcgaaaccctgtctccactaaaaatacaaaaattagccaggcatgatgatgggcacctgtaatcccagctactcaggaggctgagacagaagaatcgcttgaacccaggaggtagaggttgcagtgagctgagatcaccccactgcactccagcctgggtgacagagtgaaactccgcctcaaaaaaaaaaaaaagagaaaagaaatatagaaattaaagcatacatggccaggcgtagtggctcatgtctgtaatcccagcactttgggaggctgaggcaggcagatcacttgaggccatgagttcaagaccaacctggccaacatggcgaaagcctgtctctactaaaaatacaaaaaaattagttgggcatggtggtgcacacctgtaatcacagctactttggaggctgaggcaggagaatcgtttgaacccagaggtggaggttgcagtgagccgagattgtgccactgcactctatcctgggtgacagagcgagatactgtctcaaaaagaaaaaaaaaaggctgggcgcggtagttcatgcctgcaatcccagcactttgggaggccgaggcaggcagattacgaagtcaggagatggagaccatcctggctaatacagtgaaaccccgtctctactaaaaaatacacaaaaattagctgggtgtggtggcaggcacctgtagtcccagctactctggaggctgaggcaggagaatggcatgaacccgggaggtggagcttgcagtgagcagagatcacaccactgcactccagtctgggcgacagagcgaggctctgtctcaaaaaaaaaaaagaaagcatactctcacctccttcagtgactgatgttagtattttggcacattctttttctgtgacatatacacacttaccttgtaagtgttgtactcatttcctatgacagtaaatagtctttgtaacaggctgcatgatatttcataaaatgaatggatgtggcataatttatatgtgagccttttgaattctgctattataattaatattgcaatgaacaattcttatattgcctctacacctcaaatgtcttatcatttcttctagtttttctgaggatgtcagattattgggttaaaggatatgaacatttttaaggccttggaacagatttctaaattgctttccagaataattcccatgtgatactttcaccatgtttatttcagacttttttttttttttttttttgagacgaaatctcactctgtcacccaggctggagtgtagtggcatgatctcggctcactgcaacctccgcctcctgagtttaagcgattattctgcctcagcctcccaagtagctgcggttacaggcaagtgcctccatgcctggctaatttttgtgtcttttgtagacatggggtttcaccatgttgcccaggctggtttcgaactcctgagctcaggcaatctgcctacctcggcctcccaaagttctgggattacaggcgtgcaccaccgcgcccagccatcagagtcttttttgtcaaaataaaatggtctaaagacatacatcatagagaaactataatacaaaatttacaggtatatctaagaaaagaaaagtatatttaaagcataaaaataaactgctcttttacttaaaattttttaaaaactggattaaaaatatgaaacttccaacaaattgagcttttttttttttttttttcttttttgagacgaggtctcgcttttgtcacccagtctggagtgcagtggcgcgatctcggctcactgcaacctccacctccctggttcaagcaattcccctgcctcagcctcccaagtagctgggattacaggcgcatgccaccacgtcgggctaatttttttgtatttttagtagagagggggtttcaccatgttggccagactggtctcgaactcctgatctcaggcaatctgccagcctgggtctcccaacatgctgggattacaggcatgagccactgcactcggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctacttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttgtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcataaagtaatcatagttttcatgcattaaaaaaactagttttggctgggcgctatggctcacgcttgtaatcccagcactttcggaggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcaagactccatctcaaaaaaaaaaaaaaaaaaaaaaaaactccctattacagattcataatttatgagtcattaaataatattttcaagccatgacattttttccagcagtagtctctaaatctgttttaccatcataaaaccccaagcaaaactctactacatcagctgtgtcactgtaaaacctgccttaactcacagaagcatgaaattaagcaatgtgtgtgaaactattttataaactgtaaagtattccatacatacatgttggcagttattaatgtcttctctaggtgtggctttgaaatggatgcagatgctttctgttacaaaaaacataagttgcaaatgttctataacaaggagagacacaaatatcttcatggacatggattgctatgagtgtttgattgcctaatacttgagccaccacttcagtgatatggtataatttatcaaacagtgttgagaaacagaaactactggggatgttttaaagaggaaaatacttaatatagaaattaggggtttacataatcttaagaaaggatgaaggtgcagctcttagccaggcctccacagtaccacaaaccaacttgcaggaagagctgtaaccactgccccagttgggacaatgggtaatgaggatattaaatttaagaacatactgctatagcaatgatccttggcatagaaagctgccaccacaattgcctagagatgggaacatgaagtctggcccccattgcaacagcagtgaagcagaattttgggactggcatctcccaaatggctttgcttgccaccagagaacaaccaaagtggagggagatggctaggcctcatttctgcctattttattttattttttgagacggagtcttgtctgtcgcccaggctggagtgcagtagtgtgatctcggctcactgcagcctccgcctcccagcttcaaacaattctcctgcctcagcctcctgagtagctgggattacaggcacccgccactgtgcccagccaattttcttatttttagtagaggtggggttttgccacgttggccaggctggtcttgaactcctgacctcaggtgatctgcccgcctcagcctcccaaagtgttgtgattacaggtatgagccaccatgcctggcccatttctcccttttttttttttttttttttttgaggtggagtctcactctgttgcccagactggagtgcagtggtgcaatcttggcgcattgcaacctctgcctcccagtttcaagcaattcttctgcttcagcctcctgagtagctgggactacaggtgtgtagcaccacacctggctaatttttgtttttgttttgttttttttgagacagagtctcactctgtcacccaggctggagtgtagtggcatgatctgggctcactacaacctccgcctcccgggttcaagcaattctcctgcctcagcctccagagtagctgggattacaggtgtgcgccaacacacctggctaatttttttgtatttttaatagagatggggtttcaccatgttggccaggctggtctcgaactcctgacctcgtgatccgcccgcctcggcctcccaaagtgctgggattacaggcatgagccaccgtgcccagacaaggtttgtatttttagtagagacagttttgccatgttggccaggctggtcttgaactcctcacctcaggtgatccgcctgccttggcctcccaaagtgctgggattacaggcgcaagccactgtgcctgacccgtttctgctttttaaagctcatgtgagcacttaatttgtaaccagaatcctacttgtaaaataatctaagacatgtagcttttagctttgtaacctctataatattgatggcacagtgggagtggatgctgagtaccacttgaacatgttccacctcagtgtcttcacagctggaaggtgtctacattgtttcaaggtggacaattgatttacttctcatttttcataaactaaaagtagaataaaggctattcctctaaaattgctatctcacctgtcactcccttgcattctcacataccttcttgagtggaggggcagagggcatggagtgatagcagatgtgccaggaattctccataactcagtccgtccctcttgtgctatgttgcagcatcaggatttgctaatgggaggatactgcccttacgtgcatcattagccatgcacactaaggtcttacacctacacacaggtcagtattctggctcagagaccaacagggagaaattgcagttctcattagttgaactttctttattgttcacagttttaaaacacaaaattgagaggaactctataaaaaatgtgccattctattaataattgttgctggtaatttaaaaatccttgttccttttcaaattcttatataccttttttttttaaacacttgatcttagccaaaagaccgagaagcaatcttttttttttttttttttttttttaacctatagcttctcactgagattgtcagctgtttgtaagttttggtttttggttttctgtgtttgtatttacatatatgaaatacagattgagtatcccttatccaaaatgcttaagactggaagtgttttagatttggggttttttaggatttgtgaatatttgcactatacttaccagttaagcattccaaatccaaaatttcaaatctgaagtgttccactgagcacctcttttgagtatcatgttggtgctcaaaaagtttctgattttggagcatttggatttctgattctcggatttaggatgcttgacctgtaatttcagatttacataaaagcagaaatagtacacagagctccttatatccttcacccagattccccaattattggcctttctgaaccatttgggaataatatgcagatatgattttccattatgtctcagttgttcagtgtatattttctaagtacaagaatatattcctacatatttacatgataaccgtcatgtttaaacattttaaaatggggatttgtattacattgtttctctttttgaaaaaattacagaggagcttaatgcaatcagtattacttaaaatctgataatgtgtgttaaatagtagttttcatttatttcatttatcaggtgttcagtgaatgcttactatgtaacagcacagttatcagcactggggaaatagatgagtaagataagatttgcactttcattagcttacatgccataaagagggaaataaagagaacaccagatgatgataagtttatgctgagaattaaaatgaagtgatgaaataatgggaatgtcaggtggctacttttggtgggatggtcaggaaaggcatctctggggagataaattttaagctcagacctgagtgaaaagaatgagccagccatggaaacattatgttaactcacatggtagtttgaaatgctttatctgatcaaaggtacttatttttggtgactttcaacaatattaagggtctataaaccaacactcatttgcataagaataactaccagtgaatctttttgtatgataggttttttgtttgttgtttttttgagacagagtctcgctctgtcgcccaggctggagtgcagtggcgcgatcttggctcactgcaacctctacctccccggttcaagtgattctcctgcctcagcctcccaaagtagctgggattacaggtgcctgccaccacgcctggctaatttttgtatttttagtagagatggggtttcaccgtgttgtccaggctcgtgtcaaacttctgacctcaagccatccacccgcctcggcctcccaaagtgctgggattacaggtgtgagccaccactcctggccatgataggttattttgtgatgaaaatacctacctcttaatttgtctgataaatttaaattttatgtctagatttcctaagatcagcacttccatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccaaaaattccttagacatcatggatatttttctttttttgagatggagtcttgctctgtcacccaggctggagtgcagtgtcgcgatctcggctcactgcaagctctgcttcctgggttcatggcattctcctgcctcagcctcctgagtagctgggactacaggcgcccgccacatcgcctggctaattttttgtatttttagtagagacagggtttcaccatgttagccaggatggtctcaatctcctgacctcatgatccgcccgcctcggcctcccaaagtgctgggattacaggcgtgagccatcacgtccggccagaaatcatgaatattagtaggtgaaaaataaacacattttaccacctggaaaatgaaaaatacttgagtataatctaaataacaatgggaagtgcagagttactttccaggtctcggtttaaatatgtcttaaactttggccaattagtagtagaagttgagagaaaaagtaactatctgacaaagaaattataagcagaatatataaagaactcttaaaactgaataatcagaaaacaactcaataaaaaggtgaaggatttgaaaagatatttcaccaaataagacatagggatgacaaataagcacatgaaaagactctcagcatcactagtcacagggaaatgcacgataaaaccacagtgagacaccatggcacccctgtaggtatggctttaatgaagaaataaaactgacaataccaagtgttggcaaggatccaagcagctgagactcatatactgttaatgggaatgtaaaagtgtacagctttggaaaacagtttggcatttttttgataaatgtatacttagccatgtgatccagcagtcccaatcatgtatatataaccaaaagaaaagaaaacttaggttcacataaaaacttatatcaaatgcttatagctgaccaggcatggtggcccatgcctataatcccagcactttgggaggccgaggttggcagatacctgaagtcaagtgttcgagaccagcctggccaacatggcaaaaccctgtctctacttaaaatacaaaaattagccaggcgtgatggcaggcacctgtagtccagctattcaggaggctgaggcaggagaatcacgtgaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggctgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaacccgggaggcggagattgcagtgagccaagattgtgccattgaactccagcctgggtgacaagaccaaaactccttctcaaaaaaaaaaaagattatagcatctttattcatcattgcccaaaattacaaactgcctaaatgtagaccttcatttagttaatgaatgcacaaactgtggtatatccaaacaattgaataaaaaaaggaatgaactggtacttttttctattcctcctgtttaagtacagccaaaacacctcaacatttgtataaaacatgagctgggctgggtgcggtggctcacacgtgtaatcccagcactttgggaggctgaggcgggtggatcacctaaggttgggagttcaagaccggtctgaccaacatggagaaaccctgtctcaactaaaaatacaagattagtcgggcatggtggcgcatgcctgtaatcccagcttcttgggaggctgaggcaggagaattgcttgatcccgggaagcgaaggttgcagtaagctgagattgcaccattgcactccagcctgggcaacaagagcaaaactctgtctcaaaaagaaaaaaaaaaccattcagctgaatctcaaaggcagagagaagacagactggctagggaccttggaaccagaggagcagtgtggtggggagtggactggattttctttttgcctcatttatcctggacttggtgctggagaagctatgggttcagaccaagagaaaaccccatgaaaagcctgctctctctagccaaaagaggcaacctagcaagataaaaacctttagataataagcacttgactccagtcaaacaaaacagaataaactggccccattcacccctgtcagcaaaggccaagtgggagccaagatatgtaccccaacctggaagtcataaggtacacttctcccctttcccagccaaggtggtgttagagaaggctgactggggagctgggattctcattccctccaggaggtgataacactcctttcacatggtgtcagtggtcacagggaggctgaacttccacccagtaatacataggcatctctctggctcctatatgggtgatgttggagaagaggccgagtagagaatccagactgttgctgacacccagcagtaacaaggacacctccacaatgtccgtggaggccatgtggagatcagtaacaaggcactgctctccctcccagtcagagagatgtcagtggaggactagggggctagaactcccatgtgcgttcagcagtaatccccatgaccgccactccttgacatcacaggccttgaagaaacctggactttcactcccctctggttgtagcgaggtggcactcccttttccctgttgccagtgctgtgtcagtggaggcttgctaaattggaagatgtaaataagattcacattctcataacataataccccaaattttcaggatttaattgaaaatcactaagctgggcatggtggctcacacctgtaatcccagcactttgggaggccaaggtgggccaaacacttaaggtcaggaattcaagaccagcctggccagcatggtgaaaccctgtctctactaaaaatacaaaaattagctgggcgtggtggcacatgcctgtaatcccagctactgggaaggctaaggcaggaaaatcactggaacctgggagacggaggttgcagtgatccaagatcgcactagtgtactgcagcctgggcaacagagcaagactccatctaaatttgtgtcaggattcccagaaggagatgagaaagggtggggctgaaaaaaattgaggaagaagtcatggctgaaaatttcccaaatttggcaaaagtcagaaacctacagattgaaaaagctgaatgaagctcaaatatgataaactcaaagaagttcacacagagacacatcacagtcagatttctgaacactgcagacaaaaaatgaagatctcgaaattagcaagaaatgaccttacctaagcaatttgaatgacagcagatttcccatcagagatcataaaggccagaaggaaggggtacatacaacattttttctagtgctgaaagacaaaaactctaggctgggcacggtggcacacacctgtaatcccagcacttttggaggctgaggcaggcagatcacctgaagtcaggagttcgagaccagcctggccaacatggggaaaccctgtctctactaaaaatacaaaaattagccaggtgtggtggcacgcacctataatcctagctacttgggaggctgaggcaggggaatcgcttgaacctgggaggcgacggttgcagtgagccaaggtcgcgccactgcactccagcctgggcagttgagcgagactccatctcaaaaaaaaaaaaattatccaggcttggtggtgggcgcctatagtcccagctacttgggaggctgaggcaagagaattggttgaacccaggaggtggaggttgcagtgagccaagctcatgccactgtactccagcctgggtgacagagcgagaccttgtctcaaaaaaaaaaaaaaaaaaaaaaaacaagaaaaaaactctaaacccagagttacatatccagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaattttctaaattgtatgatggttgaagcaagaattatagcactgatttggttttcagtatatatattggaaatatttaaggcattatgttacagatgaaggagggtcaaaggatataaagggaggtaacctttctatatttcttttgtactgatgcaggcactttggaaaataatttcactatttgtttaaaaactgaacataccctgaccatatgacatagcatctatactcctgggcatttatcccagagaaacagaaatttatttattttttttttagtattacactccgtaagtgctgtaatactagcacttagggaggctgaggcaagcagattgcttgagcccaggagttcaagaccagcctgggcaatgctgcacagtcaaaaaagaaaaacaaacatttagaaaactattttaaaagtctttaattgctgaatgcctctttggctaatatttggaagatcattattattatttttcttttttaggcagagtcttgctctgtcactgaggctggagtgcagtggcgccatctcggcttactgcaacctctgcctcccgggttcacgccattctcctgcctcagcctcccgagtagctgggactacaggcgtgtgccaccatgcccggctaattttttgtgtttttagtagagatggggtttcactatgttagtcaggatggtctccatctcctaacctcgtgatccgcccacctcggcttcccaaaatgctgggattacaggcgtgagccactgtgcccagcctggaagatcattatttagtcctacaactgacacattgttccactgacgcaattgcccaggctggtcttgaactcctgggctcaagcaatctgcctgcctcggcctccctaagtgctagtattacaggcttgagccactgtgcccagccaaaaatagaaatttatattctcacaaaaacatgtacatgaatgtttatagcagctttacttgtcataatcaaaaactggaaacaaccaaaatgtcctacagtgaaacaaactgtagtacatccatagcatgtaatactctactgtcaggattaaaaagaaacccactgttggcacaggcagcaccgtggctggatctcaggggcattatgctgagtgcaaaaaagcctcaaagggtcttacactgtatgattccacttgttcaactaaaaatgacagctgtatagagatagagaacatattagtggtttccactagttagagaaagtgggtaaaagataggtgggtgggaatataaatcgatagcagggagatctttgtggtattataacacttctatgtcttgattgtagtggtggtggttacatgaatacacgtgtgataaaatgccatgtagaactacatataacgttgtgccaatgtcaatatctaggttttagtttgatctttagttacataagatgtaactattgggtgaaattgggcaaaagagtacacgaaacctctcttaaatatctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataacgcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcatgcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatactgagggccaaacaaagcacatcaaatttttaagtgctgcttttcctcattttatccaactctggacaccagaatccaaatgtagtgattggaatccacctagactgattgaggaatatattgtcctcaaattttatgagggttgactattcattttaactttaattaggattgggcacaaattttgaaacataataacattacaggaccggggcccgatccagaccccaagagagggttcttggatcttgtgcaagaatgaattcagggcaagtccataaattgaaagctagttcattaagaaagtagaggaataaaagaatggctaccccataggtagagcagccctgagggctgctggttgccatgtccacccccgcgccccctccccccgctttgttgttgttgtttaagacagagcttcgctgtgtcatcaggctggagtgcagtggcatgatagctcactgcaacctctgcctcccgcgttcaagcaattctcctgcctcagcctcctgagtagctgggactacaggcgtgcaccaccacgcccagctaatttttgtatttttagtagagatgcggtttcaccatgttggccaggaaggtctcaatctcttgacttcgtgatccacccgccttggcctcccaaagtgctgggatgagccacctcgcctggctggttatttcttgatgatatgctaaacaaggggtggattattcatgcctgccctttttagaccatttagggtaacttcccggcattgccatggcatttgtcaactgtcatggtgccaatgggagtgtagcagtgaggaggaccagaggtcactttcatcaccattttggctttttcagccggcttctttactgcaacctgttttatcagcaaggtttttatgatctgtatcttgtgcagaccttctatctcatcctgtgacttagaatgccttaaccatctgggaatgcagcctagtaggtcttggcctcattttaccaaccccctattcaagatggagttgctctggttcaaatgcctctgatatttccctactcccttttataagaaaacccttaatcctaagggttgcagagggatgaagatccatcttctgtattcttcaggctgaataggggtgatgatattcctgcctatgagagtctcttgtattagggtagagaggagctcagtcagtcagtatggctccctatccttcctcccttccccagcccctgacaactaccattctactttgtctctatgattctaagtatctcctataagtggaatcattcagtatttgtagggtttttttgtgactagtgtatttcacttagcatgtcaaggttcatccatgttgtagcatacgtccaaattttcttctttttaaaaactgaataatattccattgtatgatatatgcacattttgcttattcatttatccatcaaagaaaaccagtagcttttttacataccggcagtaacctggttaaaaaaataagatggaaaataccaagcccgaaaatgtcaaattcttgaataccagacaggtactataatccaagctgagcagagaggaatggcccttgtctcagccctgagccacatgtcactacatgggccccaaggagctcttgtgcccagagtcctgctaaggctcgttcttcacccctctaaagtggctcaaactagcgtaggaggccaggagggagcagattctatgccacctccattgcttccgtgccttctccagatccattttttccaaaagctgtgtttgaattctgcacaggggcatctctgtctccaacactgaaacccc

SEQ ID NO: 3 - RNA, 6713 nt, Homo sapiens
  source 1..6713: mol_type = mRNA
gagaggggcagggggcggagctggagggggtggttcggcgtgggggccgttggctccagacaaataaacatggagtccatcttccacgagaaagttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 4 - RNA, 6770 nt, Homo sapiens
  source 1..6770: mol_type = mRNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 5 - RNA, 26812 nt, Homo sapiens
  source 1..26812: mol_type = mRNA
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataacgcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcatgcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatactgagggccaaacaaagcacatcaaatttttaagtgctgcttttcctcattttatccaactctggacaccagaatccaaatgtagtgattggaatccacctagactgattgaggaatatattgtcctcaaattttatgagggttgactattcattttaactttaattaggattgggcacaaattttgaaacataataacattacaggaccggggcccgatccagaccccaagagagggttcttggatcttgtgcaagaatgaattcagggcaagtccataaattgaaagctagttcattaagaaagtagaggaataaaagaatggctaccccataggtagagcagccctgagggctgctggttgccatgtccacccccgcgccccctccccccgctttgttgttgttgtttaagacagagcttcgctgtgtcatcaggctggagtgcagtggcatgatagctcactgcaacctctgcctcccgcgttcaagcaattctcctgcctcagcctcctgagtagctgggactacaggcgtgcaccaccacgcccagctaatttttgtatttttagtagagatgcggtttcaccatgttggccaggaaggtctcaatctcttgacttcgtgatccacccgccttggcctcccaaagtgctgggatgagccacctcgcctggctggttatttcttgatgatatgctaaacaaggggtggattattcatgcctgccctttttagaccatttagggtaacttcccggcattgccatggcatttgtcaactgtcatggtgccaatgggagtgtagcagtgaggaggaccagaggtcactttcatcaccattttggctttttcagccggcttctttactgcaacctgttttatcagcaaggtttttatgatctgtatcttgtgcagaccttctatctcatcctgtgacttagaatgccttaaccatctgggaatgcagcctagtaggtcttggcctcattttaccaaccccctattcaagatggagttgctctggttcaaatgcctctgatatttccctactcccttttataagaaaacccttaatcctaagggttgcagagggatgaagatccatcttctgtattcttcaggctgaataggggtgatgatattcctgcctatgagagtctcttgtattagggtagagaggagctcagtcagtcagtatggctccctatccttcctcccttccccagcccctgacaactaccattctactttgtctctatgattctaagtatctcctataagtggaatcattcagtatttgtagggtttttttgtgactagtgtatttcacttagcatgtcaaggttcatccatgttgtagcatacgtccaaattttcttctttttaaaaactgaataatattccattgtatgatatatgcacattttgcttattcatttatccatcaaagaaaaccagtagcttttttacataccggcagtaacctggttaaaaaaataagatggaaaataccaagcccgaaaatgtcaaattcttgaataccagacaggtactataatccaagctgagcagagaggaatggcccttgtctcagccctgagccacatgtcactacatgggccccaaggagctcttgtgcccagagtcctgctaaggctcgttcttcacccctctaaagtggctcaaactagcgtaggaggccaggagggagcagattctatgccacctccattgcttccgtgccttctccagatccattttttccaaaagctgtgtttgaattctgcacaggggcatctctgtctccaacactgaaaccccttttgccagacccagagaagatttaactgcctttttttttgagacagggcctcgttctgtcacctaagctggagtgcagtggcacgatcttggctcacggcaacctctgcctcctgggctcaagcaattctcctgcctcagccacccgaatagctgggattataggcgcaggccaccacatccagctaagttttgtatttttagtagagacgcagttttgccatgttgcccaggctggtctagaacttctgagctcaggtgatccacccgcctcggcctcccaaagttctgggatgacaggcatgagccacctaacctggccagatttaactgctttgagccaccgtctcacacatcttccaggagcttctagtcaaatgcagaggattaatagtgtataattccatttacataagatctttggaatagtcaaactcatagagacagaaagtagaatggtggttgccgggggatggttgaggggaaaattaggagttgtttaacgagtatggagtttcagtttgggaagatgaaaaaagttctggagatggacagttgtaatggctgcacaacaacgtgaatgtacttaatgccggtgaaccgtataaccatttaacaactgaaaatggttacaaaattttgtgttatatatatcttatcacaataaaaaatatagaggattgatcactatatttgctcccttccaaaatctcacctaggttaaagtaaagaaaaatatataaacccacaagaacacagggaccaggagaggagatgcattcattggattacgtttggttgtaaaaaaaacaaaaaatcctccccggcacggtggctcacaccttgtaatcccagcactttgggaggctgaggcaggcggatcacgaggtcacgagtttgagaccagcctgaccaacatggtgaaacctcatctctactaaaaatacaaaaattagccgggtgtggtggcgtacgcctgtaatcccagctactgaagtggctgagacaggagaattgcttgaacccgggaggcggaggttgcagtgagccgagatcacgccactgcactccagattaggtgacagaacaagactccatctcaaacaaaaacaaaaacaaaaacaaactaatataacagtgactttacatgctatgggttttttttctcctctcatcttcaagaaatgtggagactgccagtccggggatgatacagcatcacagtgtcaggaatctgctctttctgtataattgttacaggaaaggggtccggatccagaccccaagagagggttcttgaattcagggcaagtccacagtgcaaagtgaaagcaagtttactaagaaagtaaaggaataaaaaaatcgctactccatagacagagcagccctgagggctgctggttgcccatttttatggttatttcttgatgatatgctaaacaaggggtggattattcatgcctcccctttttagaccatatagggtaacttcctgatgttgccatggcatttgcaaactgtcatggtgctggtgggggcgtagcaccaaggaggaccagaggtcactcttgtggcctttgtggttttggtgggttttggccagctcctttactgcaacctgttttatcggcaaggactttatgacctgtattttgtgttgaccttgtatctcatcctgtgacttagaatgccttaaccatctgggaatgcagcccagtaggtttcagcctcattttacccagctcctattcaagatggagttgcagccgggcacggtggttcatgcctgtaatcccagcactttgggaggttgaggcgggtggatcacaaggtcaagagttcaagaccagcctggccaacatggcaaaaccccatctctactaaaaatacaaaaattagccaggcgtggttggtgtgcgcctattatgccagctacttgggaggctgatgcaggagaatcacttggatctgggaggcggaggttgcagtaagcagatatcgcgccatgcactccagcctggatgacagagcaagactccgtctcgggggaaaaaaaaaccaaaatggagttgctctggtttacaggcctctgacataatggctttatgtacatggcttccatggctagggtcagctcatagatctaatatggctgtgttggtgctcatgttgcagcccagcaatcagaaagagaaaggaggctgggtttggtggcttacacctgtcatcccagcatttcgggaggccaaggcgggaggatcacatgagcccatgagtttgagaccagcttgagcaacacagggagacctcatctctacaagaaataaaaataaattagttgggtatggtggcatgcacctgtggtcccagctattcgggaggctgaggtgagaggataccttgagcctggaggtttgaggctgcagtgagctatgatcgcaccactgcactccagcctgggcaacagagtgagaccccatctcaaataattaaaaaaaaaaaaaagaaagaaagaaaaaaaaaaggagagcagaaaaaggctatgtaccttttctttcgggttaccttctcaaagttgtgcatactacttccgtttacattacattggccagaacttaacatgacaactactagctacaaggtggtttttattctgggttgccatgcatcttagcttaagtaccctacaggtcctgagataatgattcctatgaaaatgattatttacttatttaattaatttattttgagatggagtctcactctgtcacccaggctggagatcagtggcgtgatctcggctcactgcaacctctgcctcccaggttcaagcaattctcctgcttcagtctcccgagtagctgggactacaggcatgcgccaccatgcccagcttttttgtatttttagtagagacggggtttcactatgttggccaggctgatctcgaactcctgacctcaggtgatctgcctgcctcggcctcccaaagtgctgggattacaggcgtgagccactgtgcctggctgaaaatgattttttaaaagtgttccaggaggaaatggaaagggcataggggagtaagaaagtggaaataggaaaagaaggaagccaagcaagaggagcctatcaagcaaagcctcagtcctgcagacagtctggaggcaggatattcacatcttagagttgtccaaaacagaacaggcaagctgcataattttcaactctggctgaataaggttgcatttcagctctctgggcacctggaaagtatgggctccagtaacctggaggcagtctgctgactgctggctggtgtgcacaaaagtggtaaagggatgagggagtgcaatatgggcactggcatcttggctgtcatgcatccaggtaaaaagtggaggctcaattactatatatgaaggggagaacagactttggggaacaattagcagtcatttccaggtgagacaacaacagaagagaaatgctaatttttttttttttctttgagatggagtttcgctcttgttgcccaggctggagtgcaatggcgctatatccagctcaccgcaacctccgcctcctgggttcaagtgattctcctgcctcagcctcccgagcagctgagattacaggccaccacacccagctaattttgtatttttagtagagacggggtttctccatgttggtcagggtggtctcaaactcccaacctcaggtgatccgcccgcctcagcctcccaaagtgctgggattacaggcgtgaaccaccgcacccggcgagagatgcgaacattttttttgttttttggaggatgacaagttgatgcaggaatgagcagaaccaggaggctgaatactgagtgttaaagagttcctagcaatatgcaggaaaggaaagcaacaagtatcctgagaggtgggggttagatgtagactgaaatcaggaggtgtggttaaaactctttgaaagaggctgggtgcggtggctcacataatcccagcactttgggaggccaaggcgggtgcatcatgaggtcaggagttcgagaccagcctgaccaacatgtgaaaccccgtctctactaaaaatacaaaaattagccgggcatggtggcgcatgcctgtaatcccagctactaaggaggctaaggcaggagaaccgcttgaacctgggaggcgaaggttgcagtgagccgagatcatgccattggactccagcccaggcgacagagagagatcccatctcaaaaaaaaaaaaaaaaaaaaaaaaaaagaaaggaaaagaagaaaagaaaaaagaaacagcagattccctagagaggagacattcatcactaaaaaaaaaaaaaaaaattaaaataaatcgcagaagtaaaagccctttttgaaagggctcagggtacccagcttaatgtatgaaacaaaagcaaacccacatcaaagcacaccattattaatttcagagcatcagaaataaagagaagatctgacaagcttcttggaagaaaacaaggcatagagaataatcagagtagagtagagcaggaaaacagagtcctgggtagagcgaactgagcctagccaatcgatagaattcttgatgttttgttgaaaacagaagcactttacaattctcttggtaagttttagaaagattctgtagtaatggaaaattgtacaaatttaaaaaatggaatctgttaacttcaggaagaacaaaaggtagaaaaatcaaggcaatataatcttggtacaacatttgacttagctgcaatgaataagacttacatagtcatagaaggtaaacactgattacttactttaccaaaaattatgatatcatcatattgaaagcccagaaggaagggaaataaagggaaatacaagagtgctaaatcttttatttttcaataagttggtaatgtctaaaattaataagaaaatggcaaccataagcctaatgcttagaaattcagaaaagtatcagactaaattttaaagtctactttaaactgagtctttgctttatagttgcataaataaattcattttgatggttttctcagaacagatgaactggctgggtgcggtggttcatgcctgtaatcttagcactttgggaggccaaggccgatggctcacttcaagtcaggagtttgagaccagccaaaaaattagccgggtgtggtggtgcacgtttgtaataccagctactcaggaggctgaggcaggagaatcgcttgaacctgggaggcggaggttgcagtgagccaagatggaacgactgcactccagcctgggtgacacagtgagactccgtctcaaaaaaacacaaagaacagatgaactgttttcctttgaggaatattgatgatcccactgcttgagtaatggaaaccagcttgcagctgatagttattttttgtcttttttcctgttctatccactgtcctaggtttggaatttcagctgggcagcttcgatcccaccacctgtagccactgaggttcacaggctctgtttgaggtgttgtgttagattgtgctgggttggttttgctgcttattgagtgatgaagagcaacatattagctactgagatattttgcagaaaaaggaagagatgtcttcagctcaaatgctatcaaacttgtatgtcttttaactttttattataaaaaatttcaaacatatgcaaaagcaaaagactagtttaatgaaccttatgtacccaccacccagtttcaacaattatcagttcctgacaattcttgtttcacctatcccacctctattatacacacatacaaacacacagacaccacacacacacacacacacacacacacgagagcaaagtcaacttccattattttgaagcacatccaagacatcacatcacattatttatcacattatttattaagtttcttcagtcacagtccatctcacagaaagaaatcccccatgagaaacttttaggacatagcttttatgttaattacttaatttctgcactagccatccttgcctgccttctaattttctgcactagctatccttaccttccttctaattttctaacctgccaaggattctgctgcctcaaggtatttgtttctttctgcctggattgctctttcgcagatacttacatgtctcattctttttcacccaggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcgggtaagcggtcttttccatcctctcttgctacccttcaatctccctctctcgctacccttcaatctccctgtccttccaattccagttctttttcctctctagtagagacaaaggagacacattttatccgtggacccaaaattccggcgctggtcacggactcaagaagacagtcttctcttggtgtttaatcactgcagggacgactgcctgattattcacccacactccattggtgtctgatcaccgtgggggtgcctgtcttggtcattcacccacattcccttggtggcaagtcaattgcggggacgcctgctttggctgctcacccacccccttctccgtgtctctacctttctctttaaacttacttccttcactatgggcaacattccgtcctccattcccccttctactcccttagcctgtgttctcaagaacttaaaacctcttcaactcacacctgacctaaaacctaaaagccttattttcttctgcaataccgcttggccccaatacaaactcaacagtagttccaagtggccagagaatagcactttggatttgtctgtcctacaggatctagataatttttgttgaaaaatgggcaaatggtctgaggtgcctcagatccaggcattcttttacacactggtccctccctagtctctgctcccagtgcgactcatcccaaatctttcttctttctctcctgtctgttccttcagtctccaccccaagctccgagtcctttgaatcctccttttctatggactcatctgacctctcccctcttccccaggctgctcctcaccaggctgagccaggtcccaattcttcctcagcctccggtcccccaccctataatccttttatcaccccctcctcacaccgtgtctggcttacagtttctttctgtgactagccctcccctacctgcccaacaatttcttcttaaagaggtggctggagctgaaggcatagccaagggtaatgctcctttttctttatctgacctctcccaaatcagttagcgtttaggctctttttcatcaaatataaaaactcaacccagttcatggcctgtttggcaacaacccttggacactttaccgccctagacccagaatggccagaaggccgtcttattctcaacatgcattttattacccaacccactcccgacattagaaaaagctccaaaaattagattccggccctcaaaccccacaacaggacttaattaacatcaccttcaaggtgtacaataatagagtagaggcagccaagtagtaacgtatttctgagttgcaattccttgcctccactgtgagacaaaccccagccacatctccagcacacaagaccttccaaatgcctgaactgcagcggccaggcattcctccaggactgcctaccccaggatcttgcttcaagtgccggaaatctggccactgggccaaggaatgcccccagcccaggattcctcctaagccatgtcccatctgtgcaggaccccactggaaatcggactgtccaacccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagagggtaggtccatcccctgtttaatcgatatgggagctacccactccacattaccttcttttcaagggcctgtttcctttgcccctataactgttgtgggtattgatggccaggattctaaaccccttaaaactcccccactctggcaccaacttggacaacattcttttatgtactcttttttagttatccccacctgcccagttcccttattaggccaagacattttaaccaaattatctgcttccctgattattcctggactacagccacatctcattgccacccttcttcccaacccaaagcctccttcgcctcttcctctcgtatcccccaaccttaacccacaagtatgggacacctccactccctccctggcaaccgatcaaacacccattactatcccattaaaacctaatcacccttacctggctcaatgccactattccatcccacaactggctttaagaggactgaagcctgttatcactcgcctgctacagcatgggcttctaaaacctataaactcttcttacaattctcccattttacctgttcaaaaaccggacaagtcttacaggttacctcaggatctggatcttatcaaccaaattgttttgcctatccaccctgtggtgcccaacccatacacttgtttgtcctcaataccttcctccacaactcactattccgttcttgatctcacagatgcttttttcactattccctacaccactcatcccagcctcttttgcttttacctggactgaccctgacacccatcagtcccagcagcttacctgggctgtactgccgcaaggcttcagggacagccctcattacttcagccaagctctttctcatgatatactttctttccatcccttcgcttctcaccttattcaatatattgatgaccttctactttgtagcccctcctttgaatcttctcaacaagatacttttcaacatttattctccaagggatatcggatgtccccctccaaagctcaaatttcttctccatccgttacctacctcagtataattcttcataaaaacacatgtgctctccctgctgatcatgtctgactgatctctcaaaccccaacaccttctacaaaacaacaactcctttccttcctgggcatggttggatacctttgcctttggatacctggttttgccatcctaacaaaaccattatataaactcacaaaagcaaacctagctgacctcataaatcctaaatcctttccccactcccctttccattccttaaaaaacagccctaaaagctgctcccacactagctctccctaactcatcccaacccttttttcattacacacagctgaaatgcagggctgtgcagttggaattcttacacaagagccaggaccatgccctgtagcctttctgtccaaacaacttgaccttactgttttaggctagcccccacattattcctgataccacacctgacccccatgactgtatctctctaatccacctggcattcactccatttccccatacttccttctttcctattcctcaccctgatcacacttggtttattgatggcagttccacctggcctaatcgccattcaccagcaaaggtgggctatgctatagtagtatcttccacatctatccttgaagctaccgctctgcccccctccactacctctcagcaagctgaactcattgccttaactcgagccctcgctcttgcaaaaggactacatgtcaatatttatactgactctaaatatgccttccatatcctgcaccacaatgctgttatatgggcagaaagaggtttcctcagtacgcaaaggtcctccatcattattgcctccttaataaaaactcttctcaaggccgctttacttccaaaggaagctggagtcattcactgcaagggccatcaaaaggcatcagatcccatcgctcagggcaatgcttatgctgataaggtagctaaagaagctgctagctttctaacttctgtccctcacggccagtttttcttcttctcatcagtcactcccacctattcaccgactgaaacttccacctatcaatctcttctcacacaaggcaaatggttcttagaccaaggaaaatatctccttccagcctcacaggcccattctattctgttgtcatttcataacctcttccatgtaggttacaagccactagcccacctcttagaacctctcatttcctttccatcatggaaatctatcctcaaggaaatcacttctcagtgttccatctgctattctactacccctcagggattattcaggccccctccctaccctatacatcaagttcagggatttgcccccacccaggactagcaaattgactctattcacatgccctgagttaggaaactaaaatacctcttggtctgggaagacactttcactggatgggtagaggcctttcccacagggtctgagaaggccaccacagtcatttcttcccttctgtcagaaataatttctcggtttggccttcccacctttatacagtccgataacggactggcctttactagtcaaatcacccaagcagtttctcaggctcttggtattcagtggaaccttcataccccttaccgtcctcaatcttcaggaaaggtagaacggactaatggtcttttaaagacatctcaccaagctcagcctccaacttaaaaaggactggacagtatttttacctcttgcccttcacagaattagagcccgtcctcgagaagctacagggtacagtccatttgaacttttatatggacgcactttcttgctcagccccaacctcgttccagacaccagccctctaggcgactatcttccagtcctctggcaggctagacaggaaatccaccaggctgctaatcttctcttgtctactccagattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggacaaccagcctaatctctcttcttcctcctggaagtcacaagtactccccactacttcccttaaagtcactctcatttctgaagaacagtaataacccttatgagcctaatacatcccttcattctattagctctattcatccttaccctactttttgcaacagggctttacacagtcaccccccctacttggactgaaccccaaaaacttgtcatccctactatcttctgtttactcatactcccattcactattctcaactactcataaatgccctaatcttgtttacattgcctgtttacactgtttctctaagccatcacagctggtatctcctggtgctatccccaaaccgccactcttaactccctcttagagtggatagatgatatttgctggcagggcaacctccaatattttcactctgatgaagttctattctttacttttatactcactcttattctcattcccattcttatgccaccctctacctctccccagctatctccaccacactatcaatcttactctctcctagccgtttctaatccctccttagcgaataattgctggctttgcatttccctttcttcctgcacctacacagctgcccccgccttatatacagactgggcaacatctcctgtctccctacacctccaaatttcctttaacagccctcatctttaccctcctgaagaacttcttcactttctagacaggtccagcaaggcctccccagacatttcacatcagcaagctgccgccctcctccacacttacttaaaaaacctttctccttatatcaactctactccccccacatttggatccctcacaacacaaactacttttcctgtggctgctcctttatgtatctctcagcaaagacccactggaattcccctgggtaacctttcaccttcttgatgttcattcactcttcatctccaaagcccaactacacacatcactgaaacaactggagccttccagctccgtattacagataagccttttatcaatacaggcaaacttaaaaacattagaagtaattattgcttaggaagacaccctgtatttcactccatccttggctaccttccccttgctcgtcagaccctcctcccaggccttcttgttatacccagccccgtaaataacagtgaaaggttgctcatagacactcgacgttttctcatacaccatgaaaattgaacctctccctctacacagttaccccatcagtccccattacaacctctgacggctgccgccctagctggatccctaggagtctgggtacaagacacccctttcagcactccttctcatctttttactttgcatttccagttttgcctggcacaagctctcttcttcctctgtggatcctctacctacatgtgtctacctgctaactggacaggcacatgcacactcattttccttaatcccaaaattcaatttgcaaatgggaccaaagagcttcctgttcctctcatgacaccgacatgacaaaaaagggttattccactaattcccttgcttgtcggtttaggactttctgcctcctctattgctctcggtactggaatagaaggcatttcaacctctgtcacaaccttccatagcctctctaatgacttctccactagcatcacagacatatcttaaactttatcagtacttcaggcccaagttgactctctggctgcagttgtcctccaaaactgccaaggccttgacttactcactgctgaaaaaggaaggcgctgtgtgtatgtgtgtgtgtatatatatatatatatatatatatatatattttttttttttttttttttttttttttttgagacggagtcttgctctgtcacccaggcagtggcgcatctcggctcactgctcactgcaagctccacctcctgggttcatgccattctcctgcctcagcctcccaagtagctgggactataggcgcctgccaccacgcccggctaattttttgtatttttttagtacagacagggtttcaccatgttagccaggatggtctcgatctcctgacctcatgatccgcctgcctcggcctcccaaagtgctggggttataggcgtgggccactgcgcccggccgggctctgtatatttttaaatgaagagtgttctttttacctaaatcaatctggcctggtgtatgacaatataaaaaaactcaaggacagagtccaaaaacttgccaaccaagcaagtaattatgctgaacccccttgggcactctctaatcggatgtcctgggtcctcccaattcttagtcctttaatacctgtttttctccttctcttatttggaccttgtgtcttccgtttggtttctcagttcatccaaaaccatatccaggccatcaccaatcattctatatgacaaatgctccttctaacaaccccacagtatcactccttaccacaaaatcttccttcagcttaatctctcccactctaggttcccacaccacccctaataccgctcgaagcagccctgaggaacatcgcccattatctctccatactaccccccaaaattttcaccactccaacacttcaacactattttgttttatttttcttattaatataagaagacaggaatgtctggcctctgagccaaggcctgcatgtatacatccagatggcctgaaggaactgaagaatcacaaaagaagtgaaaatggctgattcctgccttaactgatgacattaccctgtgaaattccttctcctggctcagaagctcccccaccaagcaccttgtgacccccccgcccctgcctgccagagaacaaccccctttgactgtagttttccactacccacccaaatcctataaaactgccccacccctaacaccctttgctgactctcttttgggactcagcccacctgcacccaggtgaaataaacagctttattgctcacacaaagcctgtttggaggtctcttcacacggatgcccgtgacaagtgcctgccaccacatcccactaatttttgtatttttagtagagatggggtttcaccatgttggccaggctggtcttgaacgcctgacctcaggtgatccacctgcctcggccttccaaagtgctgagattacaggcgtaagcccctgcacccggccctgttttttttttttttttttttttttacatcccggagtcacactggatatctgaatgtgcttaaaataaaattcacatctcattctggaagtgtttattaaatgctgtccctgcattcatgtgaacatcacagcccagcggttagatgtgcagactccaacgcctgactgcctgggtctgtcacttactagctgtatgaccttggatgggttacttaacatttctgggcactggtttctcattagtaaaatgaagaatgggcgcctgtagtcccagctacttgggagcctgaggcaggagaatcgctttaacccgggagacgaggttgcagtgagcctaggtcccgccattgcactccagcctgggccacagagcgaggctccatctcaaaaaataaaatttaaaaaaaaaaaattcagctttcacggagaattactactgcctggtgccatcagatcccaaatactggaggcattcccaatgttctgttcacaaactgtgcaatctgtgatagcccctcttgtgaatataatcaaagtgaaagatgccagtatacttattgctatgcttaaaagaactgcagatctatcatatccttttgaaaccaaaaaatgtggaagtctccctggctagatgctgtgtgtccacgtatcctgcaccaattgcttgaaagtcacatgacaacctttcttcctttagggaaggaagcaagcaaggtaggactctgtgtgttacagccagtgtgggtaactaaggactgagggaggtgtgggcacttgcatagctagtgccgccaataccataggagcgttgacactaaacggcacttctctattaagttgccctgctgtcttctaacgagtcattttgaaaaacggttgtccgtttttcaactacttgggtgagggcagcttcatgaaaaaagctcatcgtatgttaaagaaggtagggtttcaattgtgagctataaagccaccagaggagatttctcctatagaaggaaggtgtgtttcctgcttggacacctgaatttgcaacccatcctttcttttttcctttttccttttttttttttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaaggtaacagctggagcgagggaagggagggcttttctaagaccctgggaacgtccgtttggtccctacttccatcagtcaggagacgcggacaggtcgcaaaggaatgctgctcctcccttttttcttcacacacctcctcttgcctcttctcaacagattttctatgatgaaagaccactgggggccaggggaagagtcctggttctcctctctttaaatattctggatatctcaaagtacagtagagtgaaactgctcctacgttaagtcgagtttattttcgtttggttgatccacgcccaccactttgccctcagtttgggggctgatctcattcttaacatcttcctgtattctgacccagtttaaagaattgtatatctgttttctatttttgtaacagttgaaataactcataatttaaacacttggtgagttttgctcttttctgtcttgagtatgttatgaaacacggccatgtttttctatttaattattttttacttttccttattgtgatgatacattatagcgttccagctgagaatgtatttttgtgtataatcgcccatttcgcccatatttcgacagtagaatagggaagacaaccctattcttaaggtacccttagcaatcttcactcatttttgaagtcctcaatctcgttttactaatgaatagtgacccagagttacatggtaatcaatggctacattagttactatccattaattactattttgatttcttggcattttagtaagcaatgtttggatcaaaacagtttttaagtttcaatctaagtctgctccagggagataatgggctgttcttttgggtgagagctgctgctttgacaattgtatttcttataaataaatttaataaattagta

SEQ ID NO: 6 - DNA, 23 bp, synthetic construct
  source 1..23: mol_type = other DNA
ctatcaggacagagttcacatcc

SEQ ID NO: 7 - DNA, 23 bp, synthetic construct
  source 1..23: mol_type = other DNA
gtttctaaagacatggtcacagc

SEQ ID NO: 8 - DNA, 22 bp, synthetic construct
  source 1..22: mol_type = other DNA
aaaggccagccaccagttcagg

SEQ ID NO: 9-11 - skipped (3 entries)

SEQ ID NO: 12 - DNA, 20 bp, synthetic construct
  source 1..20: mol_type = other DNA
ccttcttcctgcgccttatt

SEQ ID NO: 13 - DNA, 23 bp, synthetic construct
  source 1..23: mol_type = other DNA
tcatggtgggtacgtatgtttag

SEQ ID NO: 14 - DNA, 25 bp, synthetic construct
  source 1..25: mol_type = other DNA
agtatgcaggcaagtctccttctgt

SEQ ID NO: 15 - DNA, 20 bp, synthetic construct
  source 1..20: mol_type = other DNA
accaccccctccagctccgc

SEQ ID NO: 16 - DNA, 20 bp, synthetic construct
  source 1..20: mol_type = other DNA
gaaccaccccctccagctcc

SEQ ID NO: 17 - DNA, 20 bp, synthetic construct
  source 1..20: mol_type = other DNA
tgatctttcatttataggat

SEQ ID NO: 18 - DNA, 20 bp, synthetic construct
  source 1..20: mol_type = other DNA
aatgatctttcatttatagg

SEQ ID NO: 19 - DNA, 20 bp, synthetic construct
  source 1..20: mol_type = other DNA
gagagaattcaagttaaacc

SEQ ID NO: 20 - DNA, 20 bp, synthetic construct
  source 1..20: mol_type = other DNA
tggacccgtcaagagagaat

SEQ ID NO: 21 - DNA, 20 bp, synthetic construct
  source 1..20: mol_type = other DNA
taattcttctccaataagtt

SEQ ID NO: 22 - DNA, 20 bp, synthetic construct
  source 1..20: mol_type = other DNA
tgctaattcttctccaataa

SEQ ID NO: 23 - DNA, 20 bp, synthetic construct
  source 1..20: mol_type = other DNA
ctgaatagccctgcggagat

SEQ ID NO: 24 - DNA, 20 bp, synthetic construct
  source 1..20: mol_type = other DNA
tacttagctgaatagccctg

SEQ ID NO: 25 - DNA, 20 bp, synthetic construct
  source 1..20: mol_type = other DNA
tgacacattaccaaagtgga

SEQ ID NO: 26 - DNA, 20 bp, synthetic construct
  source 1..20: mol_type = other DNA
ctttgacacattaccaaagt

SEQ ID NO: 27 - DNA, 20 bp, synthetic construct
  source 1..20: mol_type = other DNA
tggttaataagaaatgaaag

SEQ ID NO: 28 - DNA, 20 bp, synthetic construct
  source 1..20: mol_type = other DNA
aatttggttaataagaaatg

SEQ ID NO: 29 - DNA, 20 bp, synthetic construct
  source 1..20: mol_type = other DNA
aaaagattaccatctttcaa

SEQ ID NO: 30 - DNA, 20 bp, synthetic construct
  source 1..20: mol_type = other DNA
agaaaagattaccatctttc

SEQ ID NO: 31 - DNA, 20 bp, synthetic construct
  source 1..20: mol_type = other DNA
tcctagttttctcaattgga

SEQ ID NO: 32 - DNA, 20 bp, synthetic construct
  source 1..20: mol_type = other DNA
tctcctagttttctcaattg

SEQ ID NO: 33 - DNA, 20 bp, synthetic construct
  source 1..20: mol_type = other DNA
caagctatacctactaaaag

SEQ ID NO: 34 - DNA, 20 bp, synthetic construct
  source 1..20: mol_type = other DNA
gacaagctatacctactaaa

SEQ ID NO: 35 - DNA, 20 bp, synthetic construct
  source 1..20: mol_type = other DNA
ccattgttcttaagctatct

SEQ ID NO: 36 - DNA, 20 bp, synthetic construct
  source 1..20: mol_type = other DNA
atttatagatccactaagta

SEQ ID NO: 37 - DNA, 20 bp, synthetic construct
  source 1..20: mol_type = other DNA
agcttatgaacaattcaaca

SEQ ID NO: 38 - DNA, 20 bp, synthetic construct
  source 1..20: mol_type = other DNA
attttagcttatgaacaatt

SEQ ID NO: 39 - DNA, 20 bp, synthetic construct
  source 1..20: mol_type = other DNA
ttagcaataaatcctagatc

SEQ ID NO: 40 - DNA, 20 bp, synthetic construct
  source 1..20: mol_type = other DNA
agttagcaataaatcctaga

SEQ ID NO: 41 - DNA, 20 bp, synthetic construct
  source 1..20: mol_type = other DNA
gagggagtagtactaaactc

SEQ ID NO: 42 - DNA, 20 bp, synthetic construct
  source 1..20: mol_type = other DNA
agctttttaaatcttgaggg

SEQ ID NO: 43 - DNA, 20 bp, synthetic construct
  source 1..20: mol_type = other DNA
gctcatcaattcaagtgtat

SEQ ID NO: 44 - DNA, 20 bp, synthetic construct
  source 1..20: mol_type = other DNA
tagctcatcaattcaagtgt

SEQ ID NO: 45 - DNA, 20 bp, synthetic construct
  source 1..20: mol_type = other DNA
gcatattggttttctcattt

SEQ ID NO: 46 - DNA, 20 bp, synthetic construct
  source 1..20: mol_type = other DNA
aaacacattcaaacgcatcc

SEQ ID NO: 47 - DNA, 20 bp, synthetic construct
  source 1..20: mol_type = other DNA
acaaacacattcaaacgcat

SEQ ID NO: 48 - DNA, 20 bp, synthetic construct
  source 1..20: mol_type = other DNA
tggccaatcaattaagaaat

SEQ ID NO: 49 - DNA, 20 bp, synthetic construct
  source 1..20: mol_type = other DNA
tcatactggccaatcaatta

SEQ ID NO: 50 - DNA, 20 bp, synthetic construct
  source 1..20: mol_type = other DNA
ttagttgttcctgactttct

SEQ ID NO: 51 - DNA, 20 bp, synthetic construct
  source 1..20: mol_type = other DNA
ttcttgtgaatttagttgtt

SEQ ID NO: 52 - DNA, 20 bp, synthetic construct
  source 1..20: mol_type = other DNA
gtaatacaaattatacatta

SEQ ID NO: 53 - DNA, 20 bp, synthetic construct
  source 1..20: mol_type = other DNA
ccagtaatacaaattataca

SEQ ID NO: 54 - DNA, 20 bp, synthetic construct
  source 1..20: mol_type = other DNA
actcattaaatccatgacat

SEQ ID NO: 55 - DNA, 20 bp, synthetic construct
  source 1..20: mol_type = other DNA
ttactcattaaatccatgac

SEQ ID NO: 56 - DNA, 20 bp, synthetic construct
  source 1..20: mol_type = other DNA
cagccttttcaaacagttta

SEQ ID NO: 57 - DNA, 20 bp, synthetic construct
  source 1..20: mol_type = other DNA
agcagccttttcaaacagtt

SEQ ID NO: 58 - DNA, 20 bp, synthetic construct
  source 1..20: mol_type = other DNA
tagtatcaaaaattcagaca

SEQ ID NO: 59 - DNA, 20 bp, synthetic construct
  source 1..20: mol_type = other DNA
gttttaagaatttagtagct

SEQ ID NO: 60 - DNA, 20 bp, synthetic construct
  source 1..20: mol_type = other DNA
tcgatacaacaaacaattca

SEQ ID NO: 61 - DNA, 20 bp, synthetic construct
  source 1..20: mol_type = other DNA
actcgatacaacaaacaatt

SEQ ID NO: 62 - DNA, 20 bp, synthetic construct
  source 1..20: mol_type = other DNA
gactaaaaaaatacaaagcc

SEQ ID NO: 63 - DNA, 20 bp, synthetic construct
  source 1..20: mol_type = other DNA
tcaataatcttcactcatga

SEQ ID NO: 64 - DNA, 20 bp, synthetic construct
  source 1..20: mol_type = other DNA
acatttaaaaatgtatgttt

SEQ ID NO: 65 - DNA, 20 bp, synthetic construct
  source 1..20: mol_type = other DNA
aattagataatcacatttaa

SEQ ID NO: 66 - DNA, 20 bp, synthetic construct
  source 1..20: mol_type = other DNA
gccaaacaacaatgcttttt

SEQ ID NO: 67 - DNA, 20 bp, synthetic construct
  source 1..20: mol_type = other DNA
tggccaaacaacaatgcttt

SEQ ID NO: 68 - DNA, 20 bp, synthetic construct
  source 1..20: mol_type = other DNA
atttaataatctttgatatt

SEQ ID NO: 69 - DNA, 20 bp, synthetic construct
  source 1..20: mol_type = other DNA
ttatctttatttaataatct

SEQ ID NO: 70 - DNA, 20 bp, synthetic construct
  source 1..20: mol_type = other DNA
ctcctccttctgccattctc

SEQ ID NO: 71 - DNA, 20 bp, synthetic construct
  source 1..20: mol_type = other DNA
agtaactcctccttctgcca

SEQ ID NO: 72 - DNA, 20 bp, synthetic construct
  source 1..20: mol_type = other DNA
ctaccctaatacaagagact

SEQ ID NO: 73 - DNA, 20 bp, synthetic construct
  source 1..20: mol_type = other DNA
aaaccctacaaatactgaat

SEQ ID NO: 74 - DNA, 20 bp, synthetic construct
  source 1..20: mol_type = other DNA
aaccaaacccaaacatcccg

SEQ ID NO: 75 - DNA, 20 bp, synthetic construct
  source 1..20: mol_type = other DNA
gaaaccaaacccaaacatcc

SEQ ID NO: 76 - DNA, 20 bp, synthetic construct
  source 1..20: mol_type = other DNA
tcagcctatttcaaaagttt

SEQ ID NO: 77 - DNA, 20 bp, synthetic construct
  source 1..20: mol_type = other DNA
aaaattagtgacaactatac

SEQ ID NO: 78 - DNA, 20 bp, synthetic construct
  source 1..20: mol_type = other DNA
aaactcaaagccatctcttt

SEQ ID NO: 79 - DNA, 20 bp, synthetic construct
  source 1..20: mol_type = other DNA
ccatatatatctcagaaact

SEQ ID NO: 80 - DNA, 20 bp, synthetic construct
  source 1..20: mol_type = other DNA
aagtcatttatacagaattt

SEQ ID NO: 81 - DNA, 20 bp, synthetic construct
  source 1..20: mol_type = other DNA
cagaggtttcaaaacctgtg

SEQ ID NO: 82 - DNA, 20 bp, synthetic construct
  source 1..20: mol_type = other DNA
ttatctcaaactatccccag

SEQ ID NO: 83 - DNA, 20 bp, synthetic construct
  source 1..20: mol_type = other DNA
cccttatctcaaactatccc

SEQ ID NO: 84 - DNA, 20 bp, synthetic construct
  source 1..20: mol_type = other DNA
agtttacaaactatggtcac

SEQ ID NO: 85 - DNA, 20 bp, synthetic construct
  source 1..20: mol_type = other DNA
tggagtttacaaactatggt

SEQ ID NO: 86 - DNA, 20 bp, synthetic construct
  source 1..20: mol_type = other DNA
taaccaataataactaataa

SEQ ID NO: 87 - DNA, 20 bp, synthetic construct
  source 1..20: mol_type = other DNA
attggtataaccaataataa

SEQ ID NO: 88 - DNA, 20 bp, synthetic construct
  source 1..20: mol_type = other DNA
ctgtcccaaacaaccctgga

SEQ ID NO: 89 - DNA, 20 bp, synthetic construct
  source 1..20: mol_type = other DNA
cagaactgtcccaaacaacc

SEQ ID NO: 90 - DNA, 20 bp, synthetic construct
  source 1..20: mol_type = other DNA
ttacatgatcaaaaatttaa

SEQ ID NO: 91 - DNA, 20 bp, synthetic construct
  source 1..20: mol_type = other DNA
tttattttacaaatctacca

SEQ ID NO: 92 - DNA, 20 bp, synthetic construct
  source 1..20: mol_type = other DNA
acggtgaaaccccactatct

SEQ ID NO: 93 - DNA, 20 bp, synthetic construct
  source 1..20: mol_type = other DNA
ctatataaaaatctagtact

SEQ ID NO: 94 - DNA, 20 bp, synthetic construct
  source 1..20: mol_type = other DNA
ataaacaaagatatctgcag

SEQ ID NO: 95 - DNA, 20 bp, synthetic construct
  source 1..20: mol_type = other DNA
agcaaggcacaaataggaaa

SEQ ID NO: 96 - DNA, 20 bp, synthetic construct
  source 1..20: mol_type = other DNA
atatatcactaaatccataa

SEQ ID NO: 97 - DNA, 20 bp, synthetic construct
  source 1..20: mol_type = other DNA
tagatatatcactaaatcca

SEQ ID NO: 98 - DNA, 20 bp, synthetic construct
  source 1..20: mol_type = other DNA
attaacttgaaatattgaat

SEQ ID NO: 99 - DNA, 20 bp, synthetic construct
  source 1..20: mol_type = other DNA
atctttcatttctaaaaaag

SEQ ID NO: 100 - DNA, 20 bp, synthetic construct
  source 1..20: mol_type = other DNA
tgacactatttcaggctttg

SEQ ID NO: 101 - DNA, 20 bp, synthetic construct
  source 1..20: mol_type = other DNA
gaatgctttattcatgcttg

SEQ ID NO: 102 - DNA, 20 bp, synthetic construct
  source 1..20: mol_type = other DNA
taagaaagaaccaacttagg

SEQ ID NO: 103 - DNA, 20 bp, synthetic construct
  source 1..20: mol_type = other DNA
gaagaactttaagaaagaac

SEQ ID NO: 104 - DNA, 20 bp, synthetic construct
  source 1..20: mol_type = other DNA
tagtgaaaaatatagtttta

SEQ ID NO: 105 - DNA, 20 bp, synthetic construct
  source 1..20: mol_type = other DNA
tatagtgaaaaatatagttt

SEQ ID NO: 106 - DNA, 20 bp, synthetic construct
  source 1..20: mol_type = other DNA
acatttttttaaaagagatg

SEQ ID NO: 107 - DNA, 20 bp, synthetic construct
  source 1..20: mol_type = other DNA
tcacatataacatataaaca

SEQ ID NO: 108 - DNA, 20 bp, synthetic construct
  source 1..20: mol_type = other DNA
ctgcagatttatcactatta

SEQ ID NO: 109 - DNA, 20 bp, synthetic construct
  source 1..20: mol_type = other DNA
gatcttaaaaactacaagag

SEQ ID NO: 110 - DNA, 20 bp, synthetic construct
  source 1..20: mol_type = other DNA
cgagtcagatcctaaaatca

SEQ ID NO: 111 - DNA, 20 bp, synthetic construct
  source 1..20: mol_type = other DNA
ggtggtagttaaagagtaat

SEQ ID NO: 112 - DNA, 20 bp, synthetic construct
  source 1..20: mol_type = other DNA
taacggaaagccacaaggaa

SEQ ID NO: 113 - DNA, 20 bp, synthetic construct
  source 1..20: mol_type = other DNA
gaacataattttaattgctt

SEQ ID NO: 114 - DNA, 20 bp, synthetic construct
  source 1..20: mol_type = other DNA
gtatctaaaatcaaagaatt

SEQ ID NO: 115 - DNA, 20 bp, synthetic construct
  source 1..20: mol_type = other DNA
caagtatctaaaatcaaaga

SEQ ID NO: 116 - DNA, 20 bp, synthetic construct
  source 1..20: mol_type = other DNA
atggaaaacctcaaaatagt

SEQ ID NO: 117 - DNA, 20 bp, synthetic construct
  source 1..20: mol_type = other DNA
tttaagtttctctatcatta

SEQ ID NO: 118 - DNA, 20 bp, synthetic construct
  source 1..20: mol_type = other DNA
gtgtgcaataactagtaaca

SEQ ID NO: 119 - DNA, 20 bp, synthetic construct
  source 1..20: mol_type = other DNA
tacattacccttcatatata

SEQ ID NO: 120 - DNA, 20 bp, synthetic construct
  source 1..20: mol_type = other DNA
gcctcatttttacctttgct

SEQ ID NO: 121 - DNA, 20 bp, synthetic construct
  source 1..20: mol_type = other DNA
aggcctcatttttacctttg

SEQ ID NO: 122 - DNA, 20 bp, synthetic construct
  source 1..20: mol_type = other DNA
aagggaaagcccactatata

SEQ ID NO: 123 - DNA, 20 bp, synthetic construct
  source 1..20: mol_type = other DNA
taagaaatctaaagggaaag

SEQ ID NO: 124 - DNA, 20 bp, synthetic construct
  source 1..20: mol_type = other DNA
ttaacatttttctttgccta

SEQ ID NO: 125 - DNA, 20 bp, synthetic construct
  source 1..20: mol_type = other DNA
acttcaaacttttaattaag

SEQ ID NO: 126 - DNA, 20 bp, synthetic construct
  source 1..20: mol_type = other DNA
aatcactgtatttaccaatt

SEQ ID NO: 127 - DNA, 20 bp, synthetic construct
  source 1..20: mol_type = other DNA
caacaaaaaccaatcactgt

SEQ ID NO: 128 - DNA, 20 bp, synthetic construct
  source 1..20: mol_type = other DNA
gagttgatccagatttatgg

SEQ ID NO: 129 - DNA, 20 bp, synthetic construct
  source 1..20: mol_type = other DNA
ggaattcctatttagcaagc

SEQ ID NO: 130 - DNA, 20 bp, synthetic construct
  source 1..20: mol_type = other DNA
tagaaatatctcacattaag

SEQ ID NO: 131 - DNA, 20 bp, synthetic construct
  source 1..20: mol_type = other DNA
aagactagaaatatctcaca

SEQ ID NO: 132 - DNA, 20 bp, synthetic construct
  source 1..20: mol_type = other DNA
tgattattattttatgacaa

SEQ ID NO: 133 - DNA, 20 bp, synthetic construct
  source 1..20: mol_type = other DNA
tattttttacattaactaga

SEQ ID NO: 134 - DNA, 20 bp, synthetic construct
  source 1..20: mol_type = other DNA
tctgaaataaacatggtgaa

SEQ ID NO: 135 - DNA, 20 bp, synthetic construct
  source 1..20: mol_type = other DNA
ttatagtttctctatgatgt

SEQ ID NO: 136 - DNA, 20 bp, synthetic construct
  source 1..20: mol_type = other DNA
aagaagttagttcttaactc

SEQ ID NO: 137 - DNA, 20 bp, synthetic construct
  source 1..20: mol_type = other DNA
tgaatgcaagccattgttaa

SEQ ID NO: 138 - DNA, 20 bp, synthetic construct
  source 1..20: mol_type = other DNA
gcatgaaaactatgattact

SEQ ID NO: 139 - DNA, 20 bp, synthetic construct
  source 1..20: mol_type = other DNA
atgcatgaaaactatgatta

SEQ ID NO: 140 - DNA, 20 bp, synthetic construct
  source 1..20: mol_type = other DNA
ttatgtaaacccctaatttc

SEQ ID NO: 141 - DNA, 20 bp, synthetic construct
  source 1..20: mol_type = other DNA
taatatcctcattacccatt

SEQ ID NO: 142 - DNA, 20 bp, synthetic construct
  source 1..20: mol_type = other DNA
ttagcaaatcctgatgctgc

SEQ ID NO: 143 - DNA, 20 bp, synthetic construct
  source 1..20: mol_type = other DNA
gtatcctcccattagcaaat

SEQ ID NO: 144 - DNA, 20 bp, synthetic construct
  source 1..20: mol_type = other DNA
tattattcccaaatggttca

SEQ ID NO: 145 - DNA, 20 bp, synthetic construct
  source 1..20: mol_type = other DNA
taatggaaaatcatatctgc

SEQ ID NO: 146 - DNA, 20 bp, synthetic construct
  source 1..20: mol_type = other DNA
cctttgatcagataaagcat

SEQ ID NO: 147 - DNA, 20 bp, synthetic construct
  source 1..20: mol_type = other DNA
gaaagtcaccaaaaataagt

SEQ ID NO: 148 - DNA, 20 bp, synthetic construct
  source 1..20: mol_type = other DNA
acattgtttcacgaatcaaa

SEQ ID NO: 149 - DNA, 20 bp, synthetic construct
  source 1..20: mol_type = other DNA
ataaggaaaatacattgttt

SEQ ID NO: 150 - DNA, 20 bp, synthetic construct
  source 1..20: mol_type = other DNA
catggtcacagctgcctgaa

SEQ ID NO: 151 - DNA, 20 bp, synthetic construct
  source 1..20: mol_type = other DNA
gacatggtcacagctgcctg

SEQ ID NO: 152 - DNA, 20 bp, synthetic construct
  source 1..20: mol_type = other DNA
tgaagtttaaattattatgt

SEQ ID NO: 153 - DNA, 20 bp, synthetic construct
  source 1..20: mol_type = other DNA
actgtacaaattactgtgaa

SEQ ID NO: 154 - DNA, 20 bp, synthetic construct
  source 1..20: mol_type = other DNA
ttatttcttcattaaagcca

SEQ ID NO: 155 - DNA, 20 bp, synthetic construct
  source 1..20: mol_type = other DNA
caaaaaaatgccaaactgtt

SEQ ID NO: 156 - DNA, 20 bp, synthetic construct
  source 1..20: mol_type = other DNA
gctgtcattcaaattgctta

SEQ ID NO: 157 - DNA, 20 bp, synthetic construct
  source 1..20: mol_type = other DNA
actagaaaaaatgttgtatg

SEQ ID NO: 158 - DNA, 20 bp, synthetic construct
  source 1..20: mol_type = other DNA
taaaatagttttctaaatgt

SEQ ID NO: 159 - DNA, 20 bp, synthetic construct
  source 1..20: mol_type = other DNA
aatattagccaaagaggcat

SEQ ID NO: 160 - DNA, 20 bp, synthetic construct
  source 1..20: mol_type = other DNA
tgtaaagatatttaagagag

SEQ ID NO: 161 - DNA, 20 bp, synthetic construct
  source 1..20: mol_type = other DNA
ctgtcaattcaaaggaagtt

SEQ ID NO: 162 - DNA, 20 bp, synthetic construct
  source 1..20: mol_type = other DNA
aaccaccccctccagctccg

SEQ ID NO: 163 - DNA, 20 bp, synthetic construct
  source 1..20: mol_type = other DNA
cgaaccaccccctccagctc

SEQ ID NO: 164 - DNA, 20 bp, synthetic construct
  source 1..20: mol_type = other DNA
ccgaaccaccccctccagct

SEQ ID NO: 165 - DNA, 20 bp, synthetic construct
  source 1..20: mol_type = other DNA
ttgtctggagccaacggccc

SEQ ID NO: 166 - DNA, 20 bp, synthetic construct
  source 1..20: mol_type = other DNA
ctccatgtttatttgtctgg

SEQ ID NO: 167 - DNA, 20 bp, synthetic construct
  source 1..20: mol_type = other DNA
actccatgtttatttgtctg

SEQ ID NO: 168 - DNA, 20 bp, synthetic construct
  source 1..20: mol_type = other DNA
agatggactccatgtttatt

SEQ ID NO: 169 - DNA, 20 bp, synthetic construct
  source 1..20: mol_type = other DNA
cccaaactttcaaggcattg

SEQ ID NO: 170 - DNA, 20 bp, synthetic construct
  source 1..20: mol_type = other DNA
ccccaaactttcaaggcatt

SEQ ID NO: 171 - DNA, 20 bp, synthetic construct
  source 1..20: mol_type = other DNA
accccaaactttcaaggcat

SEQ ID NO: 172 - DNA, 20 bp, synthetic construct
  source 1..20: mol_type = other DNA
aaccccaaactttcaaggca

SEQ ID NO: 173 - DNA, 20 bp, synthetic construct
  source 1..20: mol_type = other DNA
aaaccccaaactttcaaggc

SEQ ID NO: 174 - DNA, 20 bp, synthetic construct
  source 1..20: mol_type = other DNA
tctaaaccccaaactttcaa

SEQ ID NO: 175 - DNA, 20 bp, synthetic construct
  source 1..20: mol_type = other DNA
ttctaaaccccaaactttca

SEQ ID NO: 176 - DNA, 20 bp, synthetic construct
  source 1..20: mol_type = other DNA
gttctaaaccccaaactttc

SEQ ID NO: 177 - DNA, 20 bp, synthetic construct
  source 1..20: mol_type = other DNA
agttctaaaccccaaacttt

SEQ ID NO: 178 - DNA, 20 bp, synthetic construct
  source 1..20: mol_type = other DNA
tagttctaaaccccaaactt

SEQ ID NO: 179 - DNA, 20 bp, synthetic construct
  source 1..20: mol_type = other DNA
ttagttctaaaccccaaact

SEQ ID NO: 180 - DNA, 20 bp, synthetic construct
  source 1..20: mol_type = other DNA
gattagttctaaaccccaaa

SEQ ID NO: 181 - DNA, 20 bp, synthetic construct
  source 1..20: mol_type = other DNA
ggattagttctaaaccccaa

SEQ ID NO: 182 - DNA, 20 bp, synthetic construct
  source 1..20: mol_type = other DNA
aggattagttctaaacccca

SEQ ID NO: 183 - DNA, 20 bp, synthetic construct
  source 1..20: mol_type = other DNA
acaggattagttctaaaccc

SEQ ID NO: 184 - DNA, 20 bp, synthetic construct
  source 1..20: mol_type = other DNA
actgttgaacaggattagtt

SEQ ID NO: 185 - DNA, 20 bp, synthetic construct
  source 1..20: mol_type = other DNA
gagcctctgatactctggac

SEQ ID NO: 186 - DNA, 20 bp, synthetic construct
  source 1..20: mol_type = other DNA
tgagcctctgatactctgga

SEQ ID NO: 187 - DNA, 20 bp, synthetic construct
  source 1..20: mol_type = other DNA
cctgagcctctgatactctg

SEQ ID NO: 188 - DNA, 20 bp, synthetic construct
  source 1..20: mol_type = other DNA
cgatcctgagcctctgatac

SEQ ID NO: 189 - DNA, 20 bp, synthetic construct
  source 1..20: mol_type = other DNA
aggatcgatcctgagcctct

SEQ ID NO: 190 - DNA, 20 bp, synthetic construct
  source 1..20: mol_type = other DNA
taggatcgatcctgagcctc

SEQ ID NO: 191 - DNA, 20 bp, synthetic construct
  source 1..20: mol_type = other DNA
tataggatcgatcctgagcc

SEQ ID NO: 192 - DNA, 20 bp, synthetic construct
  source 1..20: mol_type = other DNA
ttataggatcgatcctgagc

SEQ ID NO: 193 - DNA, 20 bp, synthetic construct
  source 1..20: mol_type = other DNA
atctttcatttataggatcg

SEQ ID NO: 194 - DNA, 20 bp, synthetic construct
  source 1..20: mol_type = other DNA
atgatctttcatttatagga

SEQ ID NO: 195 - DNA, 20 bp, synthetic construct
  source 1..20: mol_type = other DNA
catataaatgatctttcatt

SEQ ID NO: 196 - DNA, 20 bp, synthetic construct
  source 1..20: mol_type = other DNA
gcatataaatgatctttcat

SEQ ID NO: 197 - DNA, 20 bp, synthetic construct
  source 1..20: mol_type = other DNA
tgcatataaatgatctttca

SEQ ID NO: 198 - DNA, 20 bp, synthetic construct
  source 1..20: mol_type = other DNA
ttgcatataaatgatctttc

SEQ ID NO: 199 - DNA, 20 bp, synthetic construct
  source 1..20: mol_type = other DNA
attgcatataaatgatcttt

SEQ ID NO: 200 - DNA, 20 bp, synthetic construct
  source 1..20: mol_type = other DNA
taattgcatataaatgatct

SEQ ID NO: 201 - DNA, 20 bp, synthetic construct
  source 1..20: mol_type = other DNA
tccttataattgcatataaa

SEQ ID NO: 202 - DNA, 20 bp, synthetic construct
  source 1..20: mol_type = other DNA
tgttccttataattgcatat

SEQ ID NO: 203 - DNA, 20 bp, synthetic construct
  source 1..20: mol_type = other DNA
gtgttccttataattgcata

SEQ ID NO: 204 - DNA, 20 bp, synthetic construct
  source 1..20: mol_type = other DNA
agtgttccttataattgcat

SEQ ID NO: 205 - DNA, 20 bp, synthetic construct
  source 1..20: mol_type = other DNA
cagtgttccttataattgca

SEQ ID NO: 206 - DNA, 20 bp, synthetic construct
  source 1..20: mol_type = other DNA
ccagtgttccttataattgc

SEQ ID NO: 207 - DNA, 20 bp, synthetic construct
  source 1..20: mol_type = other DNA
accagtgttccttataattg

SEQ ID NO: 208 - DNA, 20 bp, synthetic construct
  source 1..20: mol_type = other DNA
aaccagtgttccttataatt

SEQ ID NO: 209 - DNA, 20 bp, synthetic construct
  source 1..20: mol_type = other DNA
ctgtaaaccagtgttcctta

SEQ ID NO: 210 - DNA, 20 bp, synthetic construct
  source 1..20: mol_type = other DNA
taactgtaaaccagtgttcc

SEQ ID NO: 211 - DNA, 20 bp, synthetic construct
  source 1..20: mol_type = other DNA
ctaactgtaaaccagtgttc

SEQ ID NO: 212 - DNA, 20 bp, synthetic construct
  source 1..20: mol_type = other DNA
aattttctaactgtaaacca

SEQ ID NO: 213 - DNA, 20 bp, synthetic construct
  source 1..20: mol_type = other DNA
cctaattttctaactgtaaa

SEQ ID NO: 214 - DNA, 20 bp, synthetic construct
  source 1..20: mol_type = other DNA
tcctaattttctaactgtaa

SEQ ID NO: 215 - DNA, 20 bp, synthetic construct
  source 1..20: mol_type = other DNA
ttcctaattttctaactgta

SEQ ID NO: 216 - DNA, 20 bp, synthetic construct
  source 1..20: mol_type = other DNA
tttcctaattttctaactgt

SEQ ID NO: 217 - DNA, 20 bp, synthetic construct
  source 1..20: mol_type = other DNA
gttttcctaattttctaact

SEQ ID NO: 218 - DNA, 20 bp, synthetic construct
  source 1..20: mol_type = other DNA
actgttttcctaattttcta

SEQ ID NO: 219 - DNA, 20 bp, synthetic construct
  source 1..20: mol_type = other DNA
ccactgttttcctaattttc

SEQ ID NO: 220 - DNA, 20 bp, synthetic construct
  source 1..20: mol_type = other DNA
accactgttttcctaatttt

SEQ ID NO: 221 - DNA, 20 bp, synthetic construct
  source 1..20: mol_type = other DNA
aaccactgttttcctaattt

SEQ ID NO: 222 - DNA, 20 bp, synthetic construct
  source 1..20: mol_type = other DNA
agttaaaccactgttttcct

SEQ ID NO: 223 - DNA, 20 bp, synthetic construct
  source 1..20: mol_type = other DNA
aagttaaaccactgttttcc

SEQ ID NO: 224 - DNA, 20 bp, synthetic construct
  source 1..20: mol_type = other DNA
tcaagttaaaccactgtttt

SEQ ID NO: 225 - DNA, 20 bp, synthetic construct
  source 1..20: mol_type = other DNA
ttcaagttaaaccactgttt

SEQ ID NO: 226 - DNA, 20 bp, synthetic construct
  source 1..20: mol_type = other DNA
aattcaagttaaaccactgt

SEQ ID NO: 227 - DNA, 20 bp, synthetic construct
  source 1..20: mol_type = other DNA
gagaattcaagttaaaccac

SEQ ID NO: 228 - DNA, 20 bp, synthetic construct
  source 1..20: mol_type = other DNA
gtcaagagagaattcaagtt

SEQ ID NO: 229 - DNA, 20 bp, synthetic construct
  source 1..20: mol_type = other DNA
tctggacccgtcaagagaga

SEQ ID NO: 230 - DNA, 20 bp, synthetic construct
  source 1..20: mol_type = other DNA
agatatgtatctgatattaa

SEQ ID NO: 231 - DNA, 20 bp, synthetic construct
  source 1..20: mol_type = other DNA
aagtgcaagatatgtatctg

SEQ ID NO: 232 - DNA, 20 bp, synthetic construct
  source 1..20: mol_type = other DNA
aaagtgcaagatatgtatct

SEQ ID NO: 233 - DNA, 20 bp, synthetic construct
  source 1..20: mol_type = other DNA
aaaagtgcaagatatgtatc

SEQ ID NO: 234 - DNA, 20 bp, synthetic construct
  source 1..20: mol_type = other DNA
ccaagaaaagtgcaagatat

SEQ ID NO: 235 - DNA, 20 bp, synthetic construct
  source 1..20: mol_type = other DNA
tgagccaagaaaagtgcaag

SEQ ID NO: 236 - DNA, 20 bp, synthetic construct
  source 1..20: mol_type = other DNA
ttgagccaagaaaagtgcaa

SEQ ID NO: 237 - DNA, 20 bp, synthetic construct
  source 1..20: mol_type = other DNA
taattgagccaagaaaagtg

SEQ ID NO: 238 - DNA, 20 bp, synthetic construct
  source 1..20: mol_type = other DNA
tgtaattgagccaagaaaag

SEQ ID NO: 239 - DNA, 20 bp, synthetic construct
  source 1..20: mol_type = other DNA
cctgttgtaattgagccaag

SEQ ID NO: 240 - DNA, 20 bp, synthetic construct
  source 1..20: mol_type = other DNA
aataaccttcctgttgtaat

SEQ ID NO: 241 - DNA, 20 bp, synthetic construct
  source 1..20: mol_type = other DNA
gaataaccttcctgttgtaa

SEQ ID NO: 242 - DNA, 20 bp, synthetic construct
  source 1..20: mol_type = other DNA
agaataaccttcctgttgta

SEQ ID NO: 243 - DNA, 20 bp, synthetic construct
  source 1..20: mol_type = other DNA
tagaataaccttcctgttgt

SEQ ID NO: 244 - DNA, 20 bp, synthetic construct
  source 1..20: mol_type = other DNA
atagaataaccttcctgttg

SEQ ID NO: 245 - DNA, 20 bp, synthetic construct
  source 1..20: mol_type = other DNA
tatagaataaccttcctgtt

SEQ ID NO: 246 - DNA, 20 bp, synthetic construct
  source 1..20: mol_type = other DNA
atatagaataaccttcctgt

SEQ ID NO: 247 - DNA, 20 bp, synthetic construct
  source 1..20: mol_type = other DNA
aaatatagaataaccttcct

SEQ ID NO: 248 - DNA, 20 bp, synthetic construct
  source 1..20: mol_type = other DNA
caaatatagaataaccttcc

SEQ ID NO: 249 - DNA, 20 bp, synthetic construct
  source 1..20: mol_type = other DNA
acaaatatagaataaccttc

SEQ ID NO: 250 - DNA, 20 bp, synthetic construct
  source 1..20: mol_type = other DNA
taacgacaaatatagaataa

SEQ ID NO: 251 - DNA, 20 bp, synthetic construct
  source 1..20: mol_type = other DNA
gcagatcacccttaacgaca

SEQ ID NO: 252 - DNA, 20 bp, synthetic construct
  source 1..20: mol_type = other DNA
ctggcagatcacccttaacg

SEQ ID NO: 253 - DNA, 20 bp, synthetic construct
  source 1..20: mol_type = other DNA
atctggcagatcacccttaa

SEQ ID NO: 254 - DNA, 20 bp, synthetic construct
  source 1..20: mol_type = other DNA
aatctggcagatcaccctta

SEQ ID NO: 255 - DNA, 20 bp, synthetic construct
  source 1..20: mol_type = other DNA
caatctggcagatcaccctt

SEQ ID NO: 256 - DNA, 20 bp, synthetic construct
  source 1..20: mol_type = other DNA
gcaatctggcagatcaccct

SEQ ID NO: 257 - DNA, 20 bp, synthetic construct
  source 1..20: mol_type = other DNA
cgcaatctggcagatcaccc

SEQ ID NO: 258 - DNA, 20 bp, synthetic construct
  source 1..20: mol_type = other DNA
tcgcaatctggcagatcacc

SEQ ID NO: 259 - DNA, 20 bp, synthetic construct
  source 1..20: mol_type = other DNA
ttcgcaatctggcagatcac

SEQ ID NO: 260 - DNA, 20 bp, synthetic construct
  source 1..20: mol_type = other DNA
gcttcgcaatctggcagatc

SEQ ID NO: 261 - DNA, 20 bp, synthetic construct
  source 1..20: mol_type = other DNA
ttcttctccaataagttttg

SEQ ID NO: 262 - DNA, 20 bp, synthetic construct
  source 1..20: mol_type = other DNA
ctaattcttctccaataagt

SEQ ID NO: 263 - DNA, 20 bp, synthetic construct
  source 1..20: mol_type = other DNA
gtgctaattcttctccaata

SEQ ID NO: 264 - DNA, 20 bp, synthetic construct
  source 1..20: mol_type = other DNA
ttgtgctaattcttctccaa

SEQ ID NO: 265 - DNA, 20 bp, synthetic construct
  source 1..20: mol_type = other DNA
gttgtgctaattcttctcca

SEQ ID NO: 266 - DNA, 20 bp, synthetic construct
  source 1..20: mol_type = other DNA
ggtctgttttatggactctt

SEQ ID NO: 267 - DNA, 20 bp, synthetic construct
  source 1..20: mol_type = other DNA
caggtctgttttatggactc

SEQ ID NO: 268 - DNA, 20 bp, synthetic construct
  source 1..20: mol_type = other DNA
ccaggtctgttttatggact

SEQ ID NO: 269 - DNA, 20 bp, synthetic construct
  source 1..20: mol_type = other DNA
tcatttgcttctaacactcg

SEQ ID NO: 270 - DNA, 20 bp, synthetic construct
  source 1..20: mol_type = other DNA
agccatcatttgcttctaac

SEQ ID NO: 271 - DNA, 20 bp, synthetic construct
  source 1..20: mol_type = other DNA
ttcctgagccatcatttgct

SEQ ID NO: 272 - DNA, 20 bp, synthetic construct
  source 1..20: mol_type = other DNA
attcctgagccatcatttgc

SEQ ID NO: 273 - DNA, 20 bp, synthetic construct
  source 1..20: mol_type = other DNA
cattcctgagccatcatttg

SEQ ID NO: 274 - DNA, 20 bp, synthetic construct
  source 1..20: mol_type = other DNA
tctaacattcctgagccatc

SEQ ID NO: 275 - DNA, 20 bp, synthetic construct
  source 1..20: mol_type = other DNA
tgcaaatcctcctcatcttc

SEQ ID NO: 276 - DNA, 20 bp, synthetic construct
  source 1..20: mol_type = other DNA
ctgcaaatcctcctcatctt

SEQ ID NO: 277 - DNA, 20 bp, synthetic construct
  source 1..20: mol_type = other DNA
tctgcaaatcctcctcatct

SEQ ID NO: 278 - DNA, 20 bp, synthetic construct
  source 1..20: mol_type = other DNA
ctctgcaaatcctcctcatc

SEQ ID NO: 279 - DNA, 20 bp, synthetic construct
  source 1..20: mol_type = other DNA
cctctgcaaatcctcctcat

SEQ ID NO: 280 - DNA, 20 bp, synthetic construct
  source 1..20: mol_type = other DNA
gccctctgcaaatcctcctc

SEQ ID NO: 281 - DNA, 20 bp, synthetic construct
  source 1..20: mol_type = other DNA
tgccagagccctctgcaaat

SEQ ID NO: 282 - DNA, 20 bp, synthetic construct
  source 1..20: mol_type = other DNA
agtgccagagccctctgcaa

SEQ ID NO: 283 - DNA, 20 bp, synthetic construct
  source 1..20: mol_type = other DNA
cgacttagtgccagagccct

SEQ ID NO: 284 - DNA, 20 bp, synthetic construct
  source 1..20: mol_type = other DNA
ggcgacttagtgccagagcc

SEQ ID NO: 285 - DNA, 20 bp, synthetic construct
  source 1..20: mol_type = other DNA
ttcttggcgacttagtgcca

SEQ ID NO: 286 - DNA, 20 bp, synthetic construct
  source 1..20: mol_type = other DNA
catgtcaatttcttggcgac

SEQ ID NO: 287 - DNA, 20 bp, synthetic construct
  source 1..20: mol_type = other DNA
ccatgtcaatttcttggcga

SEQ ID NO: 288 - DNA, 20 bp, synthetic construct
  source 1..20: mol_type = other DNA
cctcatcttccatgtcaatt

SEQ ID NO: 289 - DNA, 20 bp, synthetic construct
  source 1..20: mol_type = other DNA
ttcctcatcttccatgtcaa

SEQ ID NO: 290 - DNA, 20 bp, synthetic construct
  source 1..20: mol_type = other DNA
cttcctcatcttccatgtca

SEQ ID NO: 291 - DNA, 20 bp, synthetic construct
  source 1..20: mol_type = other DNA
ctgcttcctcatcttccatg

SEQ ID NO: 292 - DNA, 20 bp, synthetic construct
  source 1..20: mol_type = other DNA
tctgcttcctcatcttccat

SEQ ID NO: 293 - DNA, 20 bp, synthetic construct
  source 1..20: mol_type = other DNA
atctgcttcctcatcttcca

SEQ ID NO: 294 - DNA, 20 bp, synthetic construct
  source 1..20: mol_type = other DNA
gatctgcttcctcatcttcc

SEQ ID NO: 295 - DNA, 20 bp, synthetic construct
  source 1..20: mol_type = other DNA
agatctgcttcctcatcttc

SEQ ID NO: 296 - DNA, 20 bp, synthetic construct
  source 1..20: mol_type = other DNA
agctgaatagccctgcggag

SEQ ID NO: 297 - DNA, 20 bp, synthetic construct
  source 1..20: mol_type = other DNA
accttgcatacttagctgaa

SEQ ID NO: 298 - DNA, 20 bp, synthetic construct
  source 1..20: mol_type = other DNA
ggaactaccttgcatactta

SEQ ID NO: 299 - DNA, 20 bp, synthetic construct
  source 1..20: mol_type = other DNA
tctggaactaccttgcatac

SEQ ID NO: 300 - DNA, 20 bp, synthetic construct
  source 1..20: mol_type = other DNA
tttctggaactaccttgcat

SEQ ID NO: 301 - DNA, 20 bp, synthetic construct
  source 1..20: mol_type = other DNA
atttgtacctgatgtctgtg

SEQ ID NO: 302 - DNA, 20 bp, synthetic construct
  source 1..20: mol_type = other DNA
agatttgtacctgatgtctg

SEQ ID NO: 303 - DNA, 20 bp, synthetic construct
  source 1..20: mol_type = other DNA
gaagtaagatttgtacctga

SEQ ID NO: 304 - DNA, 20 bp, synthetic construct
  source 1..20: mol_type = other DNA
ctgaagtaagatttgtacct

SEQ ID NO: 305 - DNA, 20 bp, synthetic construct
  source 1..20: mol_type = other DNA
tctgaagtaagatttgtacc

SEQ ID NO: 306 - DNA, 20 bp, synthetic construct
  source 1..20: mol_type = other DNA
cgtctcttccgaagctcttc

SEQ ID NO: 307 - DNA, 20 bp, synthetic construct
  source 1..20: mol_type = other DNA
ctgtttttcaaagtaggctt

SEQ ID NO: 308 - DNA, 20 bp, synthetic construct
  source 1..20: mol_type = other DNA
gctgtttttcaaagtaggct

SEQ ID NO: 309 - DNA, 20 bp, synthetic construct
  source 1..20: mol_type = other DNA
tgctgtttttcaaagtaggc

SEQ ID NO: 310 - DNA, 20 bp, synthetic construct
  source 1..20: mol_type = other DNA
ctgctgtttttcaaagtagg

SEQ ID NO: 311 - DNA, 20 bp, synthetic construct
  source 1..20: mol_type = other DNA
gctgctgtttttcaaagtag

SEQ ID NO: 312 - DNA, 20 bp, synthetic construct
  source 1..20: mol_type = other DNA
tgctgctgtttttcaaagta

SEQ ID NO: 313 - DNA, 20 bp, synthetic construct
  source 1..20: mol_type = other DNA
gttttcaaatcatttctgac

SEQ ID NO: 314 - DNA, 20 bp, synthetic construct
  source 1..20: mol_type = other DNA
tgttttcaaatcatttctga

SEQ ID NO: 315 - DNA, 20 bp, synthetic construct
  source 1..20: mol_type = other DNA
ctgttttcaaatcatttctg

SEQ ID NO: 316 - DNA, 20 bp, synthetic construct
  source 1..20: mol_type = other DNA
ccttctgttttcaaatcatt

SEQ ID NO: 317 - DNA, 20 bp, synthetic construct
  source 1..20: mol_type = other DNA
tccttctgttttcaaatcat

SEQ ID NO: 318 - DNA, 20 bp, synthetic construct
  source 1..20: mol_type = other DNA
aaaggtattatttttttcct

SEQ ID NO: 319 - DNA, 20 bp, synthetic construct
  source 1..20: mol_type = other DNA
taaaggtattatttttttcc

SEQ ID NO: 320 - DNA, 20 bp, synthetic construct
  source 1..20: mol_type = other DNA
ttaaaggtattatttttttc

SEQ ID NO: 321 - DNA, 20 bp, synthetic construct
  source 1..20: mol_type = other DNA
gtatgaatatctaaattatt

SEQ ID NO: 322 - DNA, 20 bp, synthetic construct
  source 1..20: mol_type = other DNA
ggaaagtatgaatatctaaa

SEQ ID NO: 323 - DNA, 20 bp, synthetic construct
  source 1..20: mol_type = other DNA
tgttggaaagtatgaatatc

SEQ ID NO: 324 - DNA, 20 bp, synthetic construct
  source 1..20: mol_type = other DNA
aagtggaccctatgctgtaa

SEQ ID NO: 325 - DNA, 20 bp, synthetic construct
  source 1..20: mol_type = other DNA
aaagtggaccctatgctgta

SEQ ID NO: 326 - DNA, 20 bp, synthetic construct
  source 1..20: mol_type = other DNA
caaagtggaccctatgctgt

SEQ ID NO: 327 - DNA, 20 bp, synthetic construct
  source 1..20: mol_type = other DNA
acacattaccaaagtggacc

SEQ ID NO: 328 - DNA, 20 bp, synthetic construct
  source 1..20: mol_type = other DNA
gacacattaccaaagtggac

SEQ ID NO: 329 - DNA, 20 bp, synthetic construct
  source 1..20: mol_type = other DNA
ttgacacattaccaaagtgg

SEQ ID NO: 330 - DNA, 20 bp, synthetic construct
  source 1..20: mol_type = other DNA
tctttgacacattaccaaag

SEQ ID NO: 331 - DNA, 20 bp, synthetic construct
  source 1..20: mol_type = other DNA
ctctttgacacattaccaaa

SEQ ID NO: 332 - DNA, 20 bp, synthetic construct
  source 1..20: mol_type = other DNA
tctctttgacacattaccaa

SEQ ID NO: 333 - DNA, 20 bp, synthetic construct
  source 1..20: mol_type = other DNA
catctctttgacacattacc

SEQ ID NO: 334 - DNA, 20 bp, synthetic construct
  source 1..20: mol_type = other DNA
ctcatctctttgacacatta

SEQ ID NO: 335 - DNA, 20 bp, synthetic construct
  source 1..20: mol_type = other DNA
ttcctcatctctttgacaca

SEQ ID NO: 336 - DNA, 20 bp, synthetic construct
  source 1..20: mol_type = other DNA
cttatttcctcatctctttg

SEQ ID NO: 337 - DNA, 20 bp, synthetic construct
  source 1..20: mol_type = other DNA
agtcttatttcctcatctct

SEQ ID NO: 338 - DNA, 20 bp, synthetic construct
  source 1..20: mol_type = other DNA
aagtcttatttcctcatctc

SEQ ID NO: 339 - DNA, 20 bp, synthetic construct
  source 1..20: mol_type = other DNA
aaagtcttatttcctcatct

SEQ ID NO: 340 - DNA, 20 bp, synthetic construct
  source 1..20: mol_type = other DNA
aaaagtcttatttcctcatc

SEQ ID NO: 341 - DNA, 20 bp, synthetic construct
  source 1..20: mol_type = other DNA
ttatttagtcctacaaccga

SEQ ID NO: 342 - DNA, 20 bp, synthetic construct
  source 1..20: mol_type = other DNA
atcattatttagtcctacaa

SEQ ID NO: 343 - DNA, 20 bp, synthetic construct
  source 1..20: mol_type = other DNA
aagatcattatttagtccta

SEQ ID NO: 344 - DNA, 20 bp, synthetic construct
  source 1..20: mol_type = other DNA
tggaagatcattatttagtc

SEQ ID NO: 345 - DNA, 20 bp, synthetic construct
  source 1..20: mol_type = other DNA
ttggaagatcattatttagt

SEQ ID NO: 346 - DNA, 20 bp, synthetic construct
  source 1..20: mol_type = other DNA
tttggaagatcattatttag

SEQ ID NO: 347 - DNA, 20 bp, synthetic construct
  source 1..20: mol_type = other DNA
tatttggaagatcattattt

SEQ ID NO: 348 - DNA, 20 bp, synthetic construct
  source 1..20: mol_type = other DNA
atatttggaagatcattatt

SEQ ID NO: 349 - DNA, 20 bp, synthetic construct
  source 1..20: mol_type = other DNA
ctttggctaatatttggaag

SEQ ID NO: 350 - DNA, 20 bp, synthetic construct
  source 1..20: mol_type = other DNA
tctttggctaatatttggaa

SEQ ID NO: 351 - DNA, 20 bp, synthetic construct
  source 1..20: mol_type = other DNA
ctctttggctaatatttgga

SEQ ID NO: 352 - DNA, 20 bp, synthetic construct
  source 1..20: mol_type = other DNA
ttgctgaatgcctctttggc

SEQ ID NO: 353 - DNA, 20 bp, synthetic construct
  source 1..20: mol_type = other DNA
ttgcacactcaaaaaagaaa

SEQ ID NO: 354 - DNA, 20 bp, synthetic construct
  source 1..20: mol_type = other DNA
tattgcacactcaaaaaaga

SEQ ID NO: 355 - DNA, 20 bp, synthetic construct
  source 1..20: mol_type = other DNA
atattgcacactcaaaaaag

SEQ ID NO: 356 - DNA, 20 bp, synthetic construct
  source 1..20: mol_type = other DNA
aagatccaagaaaaatgccc

SEQ ID NO: 357 - DNA, 20 bp, synthetic construct
  source 1..20: mol_type = other DNA
tgcaaaaagatccaagaaaa

SEQ ID NO: 358 - DNA, 20 bp, synthetic construct
  source 1..20: mol_type = other DNA
ctgcaaaaagatccaagaaa

SEQ ID NO: 359 - DNA, 20 bp, synthetic construct
  source 1..20: mol_type = other DNA
tctgcaaaaagatccaagaa

SEQ ID NO: 360 - DNA, 20 bp, synthetic construct
  source 1..20: mol_type = other DNA
agaaaacaaactatatggaa

SEQ ID NO: 361 - DNA, 20 bp, synthetic construct
  source 1..20: mol_type = other DNA
aatgaaagccactattacat

SEQ ID NO: 362 - DNA, 20 bp, synthetic construct
  source 1..20: mol_type = other DNA
gaaatgaaagccactattac

SEQ ID NO: 363 - DNA, 20 bp, synthetic construct
  source 1..20: mol_type = other DNA
atttggttaataagaaatga

SEQ ID NO: 364 - DNA, 20 bp, synthetic construct
  source 1..20: mol_type = other DNA
taatttggttaataagaaat

SEQ ID NO: 365 - DNA, 20 bp, synthetic construct
  source 1..20: mol_type = other DNA
tgaaaggttaatttggttaa

SEQ ID NO: 366 - DNA, 20 bp, synthetic construct
  source 1..20: mol_type = other DNA
ctgaaaggttaatttggtta

SEQ ID NO: 367 - DNA, 20 bp, synthetic construct
  source 1..20: mol_type = other DNA
tactttcctgaaaggttaat

SEQ ID NO: 368 - DNA, 20 bp, synthetic construct
  source 1..20: mol_type = other DNA
agatactttcctgaaaggtt

SEQ ID NO: 369 - DNA, 20 bp, synthetic construct
  source 1..20: mol_type = other DNA
gagatactttcctgaaaggt

SEQ ID NO: 370 - DNA, 20 bp, synthetic construct
  source 1..20: mol_type = other DNA
agagatactttcctgaaagg

SEQ ID NO: 371 - DNA, 20 bp, synthetic construct
  source 1..20: mol_type = other DNA
actattatcaacatcaggaa

SEQ ID NO: 372 - DNA, 20 bp, synthetic construct
  source 1..20: mol_type = other DNA
gaaccattactattatcaac

SEQ ID NO: 373 - DNA, 20 bp, synthetic construct
  source 1..20: mol_type = other DNA
agaaccattactattatcaa

SEQ ID NO: 374 - DNA, 20 bp, synthetic construct
  source 1..20: mol_type = other DNA
tagaaccattactattatca

SEQ ID NO: 375 - DNA, 20 bp, synthetic construct
  source 1..20: mol_type = other DNA
tctagaaccattactattat

SEQ ID NO: 376 - DNA, 20 bp, synthetic construct
  source 1..20: mol_type = other DNA
ttctagaaccattactatta

SEQ ID NO: 377 - DNA, 20 bp, synthetic construct
  source 1..20: mol_type = other DNA
cttctagaaccattactatt

SEQ ID NO: 378 - DNA, 20 bp, synthetic construct
  source 1..20: mol_type = other DNA
ccttctagaaccattactat

SEQ ID NO: 379 - DNA, 20 bp, synthetic construct
  source 1..20: mol_type = other DNA
tccttctagaaccattacta

SEQ ID NO: 380 - DNA, 20 bp, synthetic construct
  source 1..20: mol_type = other DNA
acacaagaaaacactggagc

SEQ ID NO: 381 - DNA, 20 bp, synthetic construct
  source 1..20: mol_type = other DNA
caacacaagaaaacactgga

SEQ ID NO: 382 - DNA, 20 bp, synthetic construct
  source 1..20: mol_type = other DNA
tcagagaaaacaacacaaga

SEQ ID NO: 383 - DNA, 20 bp, synthetic construct
  source 1..20: mol_type = other DNA
aatgaaaaccaggtagcaga

SEQ ID NO: 384 - DNA, 20 bp, synthetic construct
  source 1..20: mol_type = other DNA
ataatgaaaaccaggtagca

SEQ ID NO: 385 - DNA, 20 bp, synthetic construct
  source 1..20: mol_type = other DNA
gaaaataatgaaaaccaggt

SEQ ID NO: 386 - DNA, 20 bp, synthetic construct
  source 1..20: mol_type = other DNA
gtgggaaaataatgaaaacc

SEQ ID NO: 387 - DNA, 20 bp, synthetic construct
  source 1..20: mol_type = other DNA
tgtgggaaaataatgaaaac

SEQ ID NO: 388 - DNA, 20 bp, synthetic construct
  source 1..20: mol_type = other DNA
ttgtgggaaaataatgaaaa

SEQ ID NO: 389 - DNA, 20 bp, synthetic construct
  source 1..20: mol_type = other DNA
ttcaaaagaattgtgggaaa

SEQ ID NO: 390 - DNA, 20 bp, synthetic construct
  source 1..20: mol_type = other DNA
ctttcaaaagaattgtggga

SEQ ID NO: 391 - DNA, 20 bp, synthetic construct
  source 1..20: mol_type = other DNA
tctttcaaaagaattgtggg

SEQ ID NO: 392 - DNA, 20 bp, synthetic construct
  source 1..20: mol_type = other DNA
catctttcaaaagaattgtg

SEQ ID NO: 393 - DNA, 20 bp, synthetic construct
  source 1..20: mol_type = other DNA
ccatctttcaaaagaattgt

SEQ ID NO: 394 - DNA, 20 bp, synthetic construct
  source 1..20: mol_type = other DNA
accatctttcaaaagaattg

SEQ ID NO: 395 - DNA, 20 bp, synthetic construct
  source 1..20: mol_type = other DNA
gattaccatctttcaaaaga

SEQ ID NO: 396 - DNA, 20 bp, synthetic construct
  source 1..20: mol_type = other DNA
aaagattaccatctttcaaa

SEQ ID NO: 397 - DNA, 20 bp, synthetic construct
  source 1..20: mol_type = other DNA
gaaaagattaccatctttca

SEQ ID NO: 398 - DNA, 20 bp, synthetic construct
  source 1..20: mol_type = other DNA
cagaaaagattaccatcttt

SEQ ID NO: 399 - DNA, 20 bp, synthetic construct
  source 1..20: mol_type = other DNA
tcagaaaagattaccatctt

SEQ ID NO: 400 - DNA, 20 bp, synthetic construct
  source 1..20: mol_type = other DNA
ctcagaaaagattaccatct

SEQ ID NO: 401 - DNA, 20 bp, synthetic construct
  source 1..20: mol_type = other DNA
cctcagaaaagattaccatc

SEQ ID NO: 402 - DNA, 20 bp, synthetic construct
  source 1..20: mol_type = other DNA
acgctaaacctcagaaaaga

SEQ ID NO: 403 - DNA, 20 bp, synthetic construct
  source 1..20: mol_type = other DNA
catgaaataatgatcccatc

SEQ ID NO: 404 - DNA, 20 bp, synthetic construct
  source 1..20: mol_type = other DNA
tcatgaaataatgatcccat

SEQ ID NO: 405 - DNA, 20 bp, synthetic construct
  source 1..20: mol_type = other DNA
gtcatgaaataatgatccca

SEQ ID NO: 406 - DNA, 20 bp, synthetic construct
  source 1..20: mol_type = other DNA
agtcatgaaataatgatccc

SEQ ID NO: 407 - DNA, 20 bp, synthetic construct
  source 1..20: mol_type = other DNA
cagtcatgaaataatgatcc

SEQ ID NO: 408 - DNA, 20 bp, synthetic construct
  source 1..20: mol_type = other DNA
ccagtcatgaaataatgatc

SEQ ID NO: 409 - DNA, 20 bp, synthetic construct
  source 1..20: mol_type = other DNA
accagtcatgaaataatgat

SEQ ID NO: 410 - DNA, 20 bp, synthetic construct
  source 1..20: mol_type = other DNA
taggaacgcaccagtcatga

SEQ ID NO: 411 - DNA, 20 bp, synthetic construct
  source 1..20: mol_type = other DNA
tttaggaacgcaccagtcat

SEQ ID NO: 412 - DNA, 20 bp, synthetic construct
  source 1..20: mol_type = other DNA
gtttaggaacgcaccagtca

SEQ ID NO: 413 - DNA, 20 bp, synthetic construct
  source 1..20: mol_type = other DNA
agtttaggaacgcaccagtc

SEQ ID NO: 414 - DNA, 20 bp, synthetic construct
  source 1..20: mol_type = other DNA
gagtttaggaacgcaccagt

SEQ ID NO: 415 - DNA, 20 bp, synthetic construct
  source 1..20: mol_type = other DNA
agagtttaggaacgcaccag

SEQ ID NO: 416 - DNA, 20 bp, synthetic construct
  source 1..20: mol_type = other DNA
cagagtttaggaacgcacca

SEQ ID NO: 417 - DNA, 20 bp, synthetic construct
  source 1..20: mol_type = other DNA
tcagagtttaggaacgcacc

SEQ ID NO: 418 - DNA, 20 bp, synthetic construct
  source 1..20: mol_type = other DNA
tttcagagtttaggaacgca

SEQ ID NO: 419 - DNA, 20 bp, synthetic construct
  source 1..20: mol_type = other DNA
ggctgatttcagagtttagg

SEQ ID NO: 420 - DNA, 20 bp, synthetic construct
  source 1..20: mol_type = other DNA
catttattctcaagtacttg

SEQ ID NO: 421 - DNA, 20 bp, synthetic construct
  source 1..20: mol_type = other DNA
tcatttattctcaagtactt

SEQ ID NO: 422 - DNA, 20 bp, synthetic construct
  source 1..20: mol_type = other DNA
ctcatttattctcaagtact

SEQ ID NO: 423 - DNA, 20 bp, synthetic construct
  source 1..20: mol_type = other DNA
gctcatttattctcaagtac

SEQ ID NO: 424 - DNA, 20 bp, synthetic construct
  source 1..20: mol_type = other DNA
aaaatgctcatttattctca

SEQ ID NO: 425 - DNA, 20 bp, synthetic construct
  source 1..20: mol_type = other DNA
gcacatgctcacacatttta

SEQ ID NO: 426 - DNA, 20 bp, synthetic construct
  source 1..20: mol_type = other DNA
gatataagtgaaaagacatt

SEQ ID NO: 427 - DNA, 20 bp, synthetic construct
  source 1..20: mol_type = other DNA
gggttgcaacaaagctgtaa

SEQ ID NO: 428 - DNA, 20 bp, synthetic construct
  source 1..20: mol_type = other DNA
aaggaaaaaataaggcgcag

SEQ ID NO: 429 - DNA, 20 bp, synthetic construct
  source 1..20: mol_type = other DNA
gaaaggaaaaaataaggcgc

SEQ ID NO: 430 - DNA, 20 bp, synthetic construct
  source 1..20: mol_type = other DNA
cctagttttctcaattggag

SEQ ID NO: 431 - DNA, 20 bp, synthetic construct
  source 1..20: mol_type = other DNA
ctcctagttttctcaattgg

SEQ ID NO: 432 - DNA, 20 bp, synthetic construct
  source 1..20: mol_type = other DNA
cttctcctagttttctcaat

SEQ ID NO: 433 - DNA, 20 bp, synthetic construct
  source 1..20: mol_type = other DNA
ctatgcttctcctagttttc

SEQ ID NO: 434 - DNA, 20 bp, synthetic construct
  source 1..20: mol_type = other DNA
actatgcttctcctagtttt

SEQ ID NO: 435 - DNA, 20 bp, synthetic construct
  source 1..20: mol_type = other DNA
gcctgcatactatgcttctc

SEQ ID NO: 436 - DNA, 20 bp, synthetic construct
  source 1..20: mol_type = other DNA
tgcctgcatactatgcttct

SEQ ID NO: 437 - DNA, 20 bp, synthetic construct
  source 1..20: mol_type = other DNA
gagacttgcctgcatactat

SEQ ID NO: 438 - DNA, 20 bp, synthetic construct
  source 1..20: mol_type = other DNA
gtcttctaacagaaggagac

SEQ ID NO: 439 - DNA, 20 bp, synthetic construct
  source 1..20: mol_type = other DNA
agtcttctaacagaaggaga

SEQ ID NO: 440 - DNA, 20 bp, synthetic construct
  source 1..20: mol_type = other DNA
tagtcttctaacagaaggag

SEQ ID NO: 441 - DNA, 20 bp, synthetic construct
  source 1..20: mol_type = other DNA
ttagtcttctaacagaagga

SEQ ID NO: 442 - DNA, 20 bp, synthetic construct
  source 1..20: mol_type = other DNA
tttagtcttctaacagaagg

SEQ ID NO: 443 - DNA, 20 bp, synthetic construct
  source 1..20: mol_type = other DNA
gtttagtcttctaacagaag

SEQ ID NO: 444 - DNA, 20 bp, synthetic construct
  source 1..20: mol_type = other DNA
atgtttagtcttctaacaga

SEQ ID NO: 445 - DNA, 20 bp, synthetic construct
  source 1..20: mol_type = other DNA
gtatgtttagtcttctaaca

SEQ ID NO: 446 - DNA, 20 bp, synthetic construct
  source 1..20: mol_type = other DNA
ggccaaatttcatgtatcat

SEQ ID NO: 447 - DNA, 20 bp, synthetic construct
  source 1..20: mol_type = other DNA
aaggccaaatttcatgtatc

SEQ ID NO: 448 - DNA, 20 bp, synthetic construct
  source 1..20: mol_type = other DNA
gaaggccaaatttcatgtat

SEQ ID NO: 449 - DNA, 20 bp, synthetic construct
  source 1..20: mol_type = other DNA
attgaaggccaaatttcatg

SEQ ID NO: 450 - DNA, 20 bp, synthetic construct
  source 1..20: mol_type = other DNA
ctattaaaattgaaggccaa

SEQ ID NO: 451 - DNA, 20 bp, synthetic construct
  source 1..20: mol_type = other DNA
gctattaaaattgaaggcca

SEQ ID NO: 452 - DNA, 20 bp, synthetic construct
  source 1..20: mol_type = other DNA
ctgctattaaaattgaaggc

SEQ ID NO: 453 - DNA, 20 bp, synthetic construct
  source 1..20: mol_type = other DNA
actgctattaaaattgaagg

SEQ ID NO: 454 - DNA, 20 bp, synthetic construct
  source 1..20: mol_type = other DNA
aactgctattaaaattgaag

SEQ ID NO: 455 - DNA, 20 bp, synthetic construct
  source 1..20: mol_type = other DNA
aaactgctattaaaattgaa

SEQ ID NO: 456 - DNA, 20 bp, synthetic construct
  source 1..20: mol_type = other DNA
aaaactgctattaaaattga

SEQ ID NO: 457 - DNA, 20 bp, synthetic construct
  source 1..20: mol_type = other DNA
catgactcaactgtaaagag

SEQ ID NO: 458 - DNA, 20 bp, synthetic construct
  source 1..20: mol_type = other DNA
tacctactaaaagatgtgaa

SEQ ID NO: 459 - DNA, 20 bp, synthetic construct
  source 1..20: mol_type = other DNA
atacctactaaaagatgtga

SEQ ID NO: 460 - DNA, 20 bp, synthetic construct
  source 1..20: mol_type = other DNA
tatacctactaaaagatgtg

SEQ ID NO: 461 - DNA, 20 bp, synthetic construct
  source 1..20: mol_type = other DNA
ctatacctactaaaagatgt

SEQ ID NO: 462 - DNA, 20 bp, synthetic construct
  source 1..20: mol_type = other DNA
gctatacctactaaaagatg

SEQ ID NO: 463 - DNA, 20 bp, synthetic construct
  source 1..20: mol_type = other DNA
agctatacctactaaaagat

SEQ ID NO: 464 - DNA, 20 bp, synthetic construct
  source 1..20: mol_type = other DNA
aagctatacctactaaaaga

SEQ ID NO: 465 - DNA, 20 bp, synthetic construct
  source 1..20: mol_type = other DNA
acaagctatacctactaaaa

SEQ ID NO: 466 - DNA, 20 bp, synthetic construct
  source 1..20: mol_type = other DNA
tgacaagctatacctactaa

SEQ ID NO: 467 - DNA, 20 bp, synthetic construct
  source 1..20: mol_type = other DNA
tttgacaagctatacctact

SEQ ID NO: 468 - DNA, 20 bp, synthetic construct
  source 1..20: mol_type = other DNA
atcaccatctttgacaagct

SEQ ID NO: 469 - DNA, 20 bp, synthetic construct
  source 1..20: mol_type = other DNA
ccagatcaccatctttgaca

SEQ ID NO: 470 - DNA, 20 bp, synthetic construct
  source 1..20: mol_type = other DNA
ttccagatcaccatctttga

SEQ ID NO: 471 - DNA, 20 bp, synthetic construct
  source 1..20: mol_type = other DNA
gttccagatcaccatctttg

SEQ ID NO: 472 - DNA, 20 bp, synthetic construct
  source 1..20: mol_type = other DNA
tgttccagatcaccatcttt

SEQ ID NO: 473 - DNA, 20 bp, synthetic construct
  source 1..20: mol_type = other DNA
atgttccagatcaccatctt

SEQ ID NO: 474 - DNA, 20 bp, synthetic construct
  source 1..20: mol_type = other DNA
tcatgttccagatcaccatc

SEQ ID NO: 475 - DNA, 20 bp, synthetic construct
  source 1..20: mol_type = other DNA
ttcatgttccagatcaccat

SEQ ID NO: 476 - DNA, 20 bp, synthetic construct
  source 1..20: mol_type = other DNA
tttcatgttccagatcacca

SEQ ID NO: 477 - DNA, 20 bp, synthetic construct
  source 1..20: mol_type = other DNA
ttttcatgttccagatcacc

SEQ ID NO: 478 - DNA, 20 bp, synthetic construct
  source 1..20: mol_type = other DNA
aattattttcatgttccaga

SEQ ID NO: 479 - DNA, 20 bp, synthetic construct
  source 1..20: mol_type = other DNA
attagtaaattattttcatg

SEQ ID NO: 480 - DNA, 20 bp, synthetic construct
  source 1..20: mol_type = other DNA
acatattttcattagtaaat

SEQ ID NO: 481 - DNA, 20 bp, synthetic construct
  source 1..20: mol_type = other DNA
aacatattttcattagtaaa

SEQ ID NO: 482 - DNA, 20 bp, synthetic construct
  source 1..20: mol_type = other DNA
gtataaatttaaacatattt

SEQ ID NO: 483 - DNA, 20 bp, synthetic construct
  source 1..20: mol_type = other DNA
acagtataaatttaaacata

SEQ ID NO: 484 - DNA, 20 bp, synthetic construct
  source 1..20: mol_type = other DNA
cacagtataaatttaaacat

SEQ ID NO: 485 - DNA, 20 bp, synthetic construct
  source 1..20: mol_type = other DNA
tcacagtataaatttaaaca

SEQ ID NO: 486 - DNA, 20 bp, synthetic construct
  source 1..20: mol_type = other DNA
atcacagtataaatttaaac

SEQ ID NO: 487 - DNA, 20 bp, synthetic construct
  source 1..20: mol_type = other DNA
aatcacagtataaatttaaa

SEQ ID NO: 488 - DNA, 20 bp, synthetic construct
  source 1..20: mol_type = other DNA
caaatcacagtataaattta

SEQ ID NO: 489 - DNA, 20 bp, synthetic construct
  source 1..20: mol_type = other DNA
aagtgtcaaatcacagtata

SEQ ID NO: 490 - DNA, 20 bp, synthetic construct
  source 1..20: mol_type = other DNA
tgcaagtgtcaaatcacagt

SEQ ID NO: 491 - DNA, 20 bp, synthetic construct
  source 1..20: mol_type = other DNA
ctatctaaacatgatgcaag

SEQ ID NO: 492 - DNA, 20 bp, synthetic construct
  source 1..20: mol_type = other DNA
gctatctaaacatgatgcaa

SEQ ID NO: 493 - DNA, 20 bp, synthetic construct
  source 1..20: mol_type = other DNA
agctatctaaacatgatgca

SEQ ID NO: 494 - DNA, 20 bp, synthetic construct
  source 1..20: mol_type = other DNA
taagctatctaaacatgatg

SEQ ID NO: 495 - DNA, 20 bp, synthetic construct
  source 1..20: mol_type = other DNA
ttaagctatctaaacatgat

SEQ ID NO: 496 - DNA, 20 bp, synthetic construct
  source 1..20: mol_type = other DNA
cttaagctatctaaacatga

SEQ ID NO: 497 - DNA, 20 bp, synthetic construct
  source 1..20: mol_type = other DNA
tcttaagctatctaaacatg

SEQ ID NO: 498 - DNA, 20 bp, synthetic construct
  source 1..20: mol_type = other DNA
gttcttaagctatctaaaca

SEQ ID NO: 499 - DNA, 20 bp, synthetic construct
  source 1..20: mol_type = other DNA
ttatagatccactaagtact

SEQ ID NO: 500 - DNA, 20 bp, synthetic construct
  source 1..20: mol_type = other DNA
ctttcttatttatagatcca

SEQ ID NO: 501 - DNA, 20 bp, synthetic construct
  source 1..20: mol_type = other DNA
gactttcttatttatagatc

SEQ ID NO: 502 - DNA, 20 bp, synthetic construct
  source 1..20: mol_type = other DNA
ttatcaaaactatggacttt

SEQ ID NO: 503 - DNA, 20 bp, synthetic construct
  source 1..20: mol_type = other DNA
tttatcaaaactatggactt

SEQ ID NO: 504 - DNA, 20 bp, synthetic construct
  source 1..20: mol_type = other DNA
atttatcaaaactatggact

SEQ ID NO: 505 - DNA, 20 bp, synthetic construct
  source 1..20: mol_type = other DNA
atatttatcaaaactatgga

SEQ ID NO: 506 - DNA, 20 bp, synthetic construct
  source 1..20: mol_type = other DNA
aatatttatcaaaactatgg

SEQ ID NO: 507 - DNA, 20 bp, synthetic construct
  source 1..20: mol_type = other DNA
ttaaagagaatatttatcaa

SEQ ID NO: 508 - DNA, 20 bp, synthetic construct
  source 1..20: mol_type = other DNA
aattaaagagaatatttatc

SEQ ID NO: 509 - DNA, 20 bp, synthetic construct
  source 1..20: mol_type = other DNA
catctcaattaaagagaata

SEQ ID NO: 510 - DNA, 20 bp, synthetic construct
  source 1..20: mol_type = other DNA
gtacatctcaattaaagaga

SEQ ID NO: 511 - DNA, 20 bp, synthetic construct
  source 1..20: mol_type = other DNA
tcctattgacccagcaagaa

SEQ ID NO: 512 - DNA, 20 bp, synthetic construct
  source 1..20: mol_type = other DNA
actatcctattgacccagca

SEQ ID NO: 513 - DNA, 20 bp, synthetic construct
  source 1..20: mol_type = other DNA
tgatactatcctattgaccc

SEQ ID NO: 514 - DNA, 20 bp, synthetic construct
  source 1..20: mol_type = other DNA
ggttttcaccaaaatgatac

SEQ ID NO: 515 - DNA, 20 bp, synthetic construct
  source 1..20: mol_type = other DNA
acatcaatttcagagacatg

SEQ ID NO: 516 - DNA, 20 bp, synthetic construct
  source 1..20: mol_type = other DNA
aacatcaatttcagagacat

SEQ ID NO: 517 - DNA, 20 bp, synthetic construct
  source 1..20: mol_type = other DNA
aaacatcaatttcagagaca

SEQ ID NO: 518 - DNA, 20 bp, synthetic construct
  source 1..20: mol_type = other DNA
gaaactaaaacatcaatttc

SEQ ID NO: 519 - DNA, 20 bp, synthetic construct
  source 1..20: mol_type = other DNA
actgaaactaaaacatcaat

SEQ ID NO: 520 - DNA, 20 bp, synthetic construct
  source 1..20: mol_type = other DNA
aaagagcttcaaaaggagat

SEQ ID NO: 521 - DNA, 20 bp, synthetic construct
  source 1..20: mol_type = other DNA
caacattcaaaagagcttca

SEQ ID NO: 522 - DNA, 20 bp, synthetic construct
  source 1..20: mol_type = other DNA
tcaacattcaaaagagcttc

SEQ ID NO: 523 - DNA, 20 bp, synthetic construct
  source 1..20: mol_type = other DNA
ttcaacattcaaaagagctt

SEQ ID NO: 524 - DNA, 20 bp, synthetic construct
  source 1..20: mol_type = other DNA
caattcaacattcaaaagag

SEQ ID NO: 525 - DNA, 20 bp, synthetic construct
  source 1..20: mol_type = other DNA
acaattcaacattcaaaaga

SEQ ID NO: 526 - DNA, 20 bp, synthetic construct
  source 1..20: mol_type = other DNA
aacaattcaacattcaaaag

SEQ ID NO: 527 - DNA, 20 bp, synthetic construct
  source 1..20: mol_type = other DNA
gaacaattcaacattcaaaa

SEQ ID NO: 528 - DNA, 20 bp, synthetic construct
  source 1..20: mol_type = other DNA
tgaacaattcaacattcaaa

SEQ ID NO: 529 - DNA, 20 bp, synthetic construct
  source 1..20: mol_type = other DNA
atgaacaattcaacattcaa

SEQ ID NO: 530 - DNA, 20 bp, synthetic construct
  source 1..20: mol_type = other DNA
tatgaacaattcaacattca

SEQ ID NO: 531 - DNA, 20 bp, synthetic construct
  source 1..20: mol_type = other DNA
ttatgaacaattcaacattc

SEQ ID NO: 532 - DNA, 20 bp, synthetic construct
  source 1..20: mol_type = other DNA
gcttatgaacaattcaacat

SEQ ID NO: 533 - DNA, 20 bp, synthetic construct
  source 1..20: mol_type = other DNA
tttagcttatgaacaattca

SEQ ID NO: 534 - DNA, 20 bp, synthetic construct
  source 1..20: mol_type = other DNA
tttcttggattttagcttat

SEQ ID NO: 535 - DNA, 20 bp, synthetic construct
  source 1..20: mol_type = other DNA
agctgaaatttcttggattt

SEQ ID NO: 536 - DNA, 20 bp, synthetic construct
  source 1..20: mol_type = other DNA
cagctgaaatttcttggatt

SEQ ID NO: 537 - DNA, 20 bp, synthetic construct
  source 1..20: mol_type = other DNA
tcagctgaaatttcttggat

SEQ ID NO: 538 - DNA, 20 bp, synthetic construct
  source 1..20: mol_type = other DNA
gtcagctgaaatttcttgga

SEQ ID NO: 539 - DNA, 20 bp, synthetic construct
  source 1..20: mol_type = other DNA
ttgtcagctgaaatttcttg

SEQ ID NO: 540 - DNA, 20 bp, synthetic construct
  source 1..20: mol_type = other DNA
agttgtcagctgaaatttct

SEQ ID NO: 541 - DNA, 20 bp, synthetic construct
  source 1..20: mol_type = other DNA
aagttgtcagctgaaatttc

SEQ ID NO: 542 - DNA, 20 bp, synthetic construct
  source 1..20: mol_type = other DNA
gaagttgtcagctgaaattt

SEQ ID NO: 543 - DNA, 20 bp, synthetic construct
  source 1..20: mol_type = other DNA
cgaagttgtcagctgaaatt

SEQ ID NO: 544 - DNA, 20 bp, synthetic construct
  source 1..20: mol_type = other DNA
tcgaagttgtcagctgaaat

SEQ ID NO: 545 - DNA, 20 bp, synthetic construct
  source 1..20: mol_type = other DNA
ttcgaagttgtcagctgaaa

SEQ ID NO: 546 - DNA, 20 bp, synthetic construct
  source 1..20: mol_type = other DNA
tttcgaagttgtcagctgaa

SEQ ID NO: 547 - DNA, 20 bp, synthetic construct
  source 1..20: mol_type = other DNA
attttcgaagttgtcagctg

SEQ ID NO: 548 - DNA, 20 bp, synthetic construct
  source 1..20: mol_type = other DNA
tattataattttcgaagttg

SEQ ID NO: 549 - DNA, 20 bp, synthetic construct
  source 1..20: mol_type = other DNA
catattataattttcgaagt

SEQ ID NO: 550 - DNA, 20 bp, synthetic construct
  source 1..20: mol_type = other DNA
tataccatattataattttc

SEQ ID NO: 551 - DNA, 20 bp, synthetic construct
  source 1..20: mol_type = other DNA
ggcaatataccatattataa

SEQ ID NO: 552 - DNA, 20 bp, synthetic construct
  source 1..20: mol_type = other DNA
agggcaatataccatattat

SEQ ID NO: 553 - DNA, 20 bp, synthetic construct
  source 1..20: mol_type = other DNA
gagggcaatataccatatta

SEQ ID NO: 554 - DNA, 20 bp, synthetic construct
  source 1..20: mol_type = other DNA
atcaaaaaactttccctgat

SEQ ID NO: 555 - DNA, 20 bp, synthetic construct
  source 1..20: mol_type = other DNA
gatcaaaaaactttccctga

SEQ ID NO: 556 - DNA, 20 bp, synthetic construct
  source 1..20: mol_type = other DNA
agatcaaaaaactttccctg

SEQ ID NO: 557 - DNA, 20 bp, synthetic construct
  source 1..20: mol_type = other DNA
ctagatcaaaaaactttccc

SEQ ID NO: 558 - DNA, 20 bp, synthetic construct
  source 1..20: mol_type = other DNA
cctagatcaaaaaactttcc

SEQ ID NO: 559 - DNA, 20 bp, synthetic construct
  source 1..20: mol_type = other DNA
tcctagatcaaaaaactttc

SEQ ID NO: 560 - DNA, 20 bp, synthetic construct
  source 1..20: mol_type = other DNA
atcctagatcaaaaaacttt

SEQ ID NO: 561 - DNA, 20 bp, synthetic construct
  source 1..20: mol_type = other DNA
aatcctagatcaaaaaactt

SEQ ID NO: 562 - DNA, 20 bp, synthetic construct
  source 1..20: mol_type = other DNA
aaatcctagatcaaaaaact

SEQ ID NO: 563 - DNA, 20 bp, synthetic construct
  source 1..20: mol_type = other DNA
taaatcctagatcaaaaaac

SEQ ID NO: 564 - DNA, 20 bp, synthetic construct
  source 1..20: mol_type = other DNA
gcaataaatcctagatcaaa

SEQ ID NO: 565 - DNA, 20 bp, synthetic construct
  source 1..20: mol_type = other DNA
agcaataaatcctagatcaa

SEQ ID NO: 566 - DNA, 20 bp, synthetic construct
  source 1..20: mol_type = other DNA
tagcaataaatcctagatca

SEQ ID NO: 567 - DNA, 20 bp, synthetic construct
  source 1..20: mol_type = other DNA
gttagcaataaatcctagat

SEQ ID NO: 568 - DNA, 20 bp, synthetic construct
  source 1..20: mol_type = other DNA
aatcataaataaaagatatt

SEQ ID NO: 569 - DNA, 20 bp, synthetic construct
  source 1..20: mol_type = other DNA
taatcataaataaaagatat

SEQ ID NO: 570 - DNA, 20 bp, synthetic construct
  source 1..20: mol_type = other DNA
aagctattttataatcataa

SEQ ID NO: 571 - DNA, 20 bp, synthetic construct
  source 1..20: mol_type = other DNA
aaaagctattttataatcat

SEQ ID NO: 572 - DNA, 20 bp, synthetic construct
  source 1..20: mol_type = other DNA
cttaaaaaatctgttatatc

SEQ ID NO: 573 - DNA, 20 bp, synthetic construct
  source 1..20: mol_type = other DNA
gacttaaaaaatctgttata

SEQ ID NO: 574 - DNA, 20 bp, synthetic construct
  source 1..20: mol_type = other DNA
tgacttaaaaaatctgttat

SEQ ID NO: 575 - DNA, 20 bp, synthetic construct
  source 1..20: mol_type = other DNA
atgacttaaaaaatctgtta

SEQ ID NO: 576 - DNA, 20 bp, synthetic construct
  source 1..20: mol_type = other DNA
aatgacttaaaaaatctgtt

SEQ ID NO: 577 - DNA, 20 bp, synthetic construct
  source 1..20: mol_type = other DNA
taatgacttaaaaaatctgt

SEQ ID NO: 578 - DNA, 20 bp, synthetic construct
  source 1..20: mol_type = other DNA
gcacaaaataatgacttaaa

SEQ ID NO: 579 - DNA, 20 bp, synthetic construct
  source 1..20: mol_type = other DNA
ggcacaaaataatgacttaa

SEQ ID NO: 580 - DNA, 20 bp, synthetic construct
  source 1..20: mol_type = other DNA
tggcacaaaataatgactta

SEQ ID NO: 581 - DNA, 20 bp, synthetic construct
  source 1..20: mol_type = other DNA
ttggcacaaaataatgactt

SEQ ID NO: 582 - DNA, 20 bp, synthetic construct
  source 1..20: mol_type = other DNA
gattggcacaaaataatgac

SEQ ID NO: 583 - DNA, 20 bp, synthetic construct
  source 1..20: mol_type = other DNA
aagggaaacttcagaaaact

SEQ ID NO: 584 - DNA, 20 bp, synthetic construct
  source 1..20: mol_type = other DNA
taagggaaacttcagaaaac

SEQ ID NO: 585 - DNA, 20 bp, synthetic construct
  source 1..20: mol_type = other DNA
gtaagggaaacttcagaaaa

SEQ ID NO: 586 - DNA, 20 bp, synthetic construct
  source 1..20: mol_type = other DNA
tgtaagggaaacttcagaaa

SEQ ID NO: 587 - DNA, 20 bp, synthetic construct
  source 1..20: mol_type = other DNA
ttagattttaaaataaagct

SEQ ID NO: 588 - DNA, 20 bp, synthetic construct
  source 1..20: mol_type = other DNA
tttaactattaaaagaaact

SEQ ID NO: 589 - DNA, 20 bp, synthetic construct
  source 1..20: mol_type = other DNA
ctgaaacatttttaactatt

SEQ ID NO: 590 - DNA, 20 bp, synthetic construct
  source 1..20: mol_type = other DNA
ataattcttctgaaacattt

SEQ ID NO: 591 - DNA, 20 bp, synthetic construct
  source 1..20: mol_type = other DNA
ttataattcttctgaaacat

SEQ ID NO: 592 - DNA, 20 bp, synthetic construct
  source 1..20: mol_type = other DNA
tttataattcttctgaaaca

SEQ ID NO: 593 - DNA, 20 bp, synthetic construct
  source 1..20: mol_type = other DNA
ttttataattcttctgaaac

SEQ ID NO: 594 - DNA, 20 bp, synthetic construct
  source 1..20: mol_type = other DNA
gttttataattcttctgaaa

SEQ ID NO: 595 - DNA, 20 bp, synthetic construct
  source 1..20: mol_type = other DNA
agttttataattcttctgaa

SEQ ID NO: 596 - DNA, 20 bp, synthetic construct
  source 1..20: mol_type = other DNA
aagttttataattcttctga

SEQ ID NO: 597 - DNA, 20 bp, synthetic construct
  source 1..20: mol_type = other DNA
taaagttttataattcttct

SEQ ID NO: 598 - DNA, 20 bp, synthetic construct
  source 1..20: mol_type = other DNA
ttaaagttttataattcttc

SEQ ID NO: 599 - DNA, 20 bp, synthetic construct
  source 1..20: mol_type = other DNA
gttttaaagttttataattc

SEQ ID NO: 600 - DNA, 20 bp, synthetic construct
  source 1..20: mol_type = other DNA
ttgcagttttaaagttttat

SEQ ID NO: 601 - DNA, 20 bp, synthetic construct
  source 1..20: mol_type = other DNA
tttttaaatcttgagggagt

SEQ ID NO: 602 - DNA, 20 bp, synthetic construct
  source 1..20: mol_type = other DNA
tagctttttaaatcttgagg

SEQ ID NO: 603 - DNA, 20 bp, synthetic construct
  source 1..20: mol_type = other DNA
ttagctttttaaatcttgag

SEQ ID NO: 604 - DNA, 20 bp, synthetic construct
  source 1..20: mol_type = other DNA
tttagctttttaaatcttga

SEQ ID NO: 605 - DNA, 20 bp, synthetic construct
  source 1..20: mol_type = other DNA
atttagctttttaaatcttg

SEQ ID NO: 606 - DNA, 20 bp, synthetic construct
  source 1..20: mol_type = other DNA
tatttagctttttaaatctt

SEQ ID NO: 607 - DNA, 20 bp, synthetic construct
  source 1..20: mol_type = other DNA
tcttaaaatatttagctttt

SEQ ID NO: 608 - DNA, 20 bp, synthetic construct
  source 1..20: mol_type = other DNA
gtcttaaaatatttagcttt

SEQ ID NO: 609 - DNA, 20 bp, synthetic construct
  source 1..20: mol_type = other DNA
agtcttaaaatatttagctt

SEQ ID NO: 610 - DNA, 20 bp, synthetic construct
  source 1..20: mol_type = other DNA
cagtcttaaaatatttagct

SEQ ID NO: 611 - DNA, 20 bp, synthetic construct
  source 1..20: mol_type = other DNA
tcagtcttaaaatatttagc

SEQ ID NO: 612 - DNA, 20 bp, synthetic construct
  source 1..20: mol_type = other DNA
ttcagtcttaaaatatttag

SEQ ID NO: 613 - DNA, 20 bp, synthetic construct
  source 1..20: mol_type = other DNA
gttcagtcttaaaatattta

SEQ ID NO: 614 - DNA, 20 bp, synthetic construct
  source 1..20: mol_type = other DNA
atgttcagtcttaaaatatt

SEQ ID NO: 615 - DNA, 20 bp, synthetic construct
  source 1..20: mol_type = other DNA
taaatgttcagtcttaaaat

SEQ ID NO: 616 - DNA, 20 bp, synthetic construct
  source 1..20: mol_type = other DNA
ataaatgttcagtcttaaaa

SEQ ID NO: 617 - DNA, 20 bp, synthetic construct
  source 1..20: mol_type = other DNA
gtaataattaacataaatgt

SEQ ID NO: 618 - DNA, 20 bp, synthetic construct
  source 1..20: mol_type = other DNA
ctggtaataattaacataaa

SEQ ID NO: 619 - DNA, 20 bp, synthetic construct
  source 1..20: mol_type = other DNA
actggtaataattaacataa

SEQ ID NO: 620 - DNA, 20 bp, synthetic construct
  source 1..20: mol_type = other DNA
ccatggaaaatatgacaaac

SEQ ID NO: 621 - DNA, 20 bp, synthetic construct
  source 1..20: mol_type = other DNA
acaaatatccatggaaaata

SEQ ID NO: 622 - DNA, 20 bp, synthetic construct
  source 1..20: mol_type = other DNA
aacaaatatccatggaaaat

SEQ ID NO: 623 - DNA, 20 bp, synthetic construct
  source 1..20: mol_type = other DNA
gaacaaatatccatggaaaa

SEQ ID NO: 624 - DNA, 20 bp, synthetic construct
  source 1..20: mol_type = other DNA
tgaacaaatatccatggaaa

SEQ ID NO: 625 - DNA, 20 bp, synthetic construct
  source 1..20: mol_type = other DNA
aatgaacaaatatccatgga

SEQ ID NO: 626 - DNA, 20 bp, synthetic construct
  source 1..20: mol_type = other DNA
taatgaacaaatatccatgg

SEQ ID NO: 627 - DNA, 20 bp, synthetic construct
  source 1..20: mol_type = other DNA
gtaatgaacaaatatccatg

SEQ ID NO: 628 - DNA, 20 bp, synthetic construct
  source 1..20: mol_type = other DNA
ggtaatgaacaaatatccat

SEQ ID NO: 629 - DNA, 20 bp, synthetic construct
  source 1..20: mol_type = other DNA
aggtaatgaacaaatatcca

SEQ ID NO: 630 - DNA, 20 bp, synthetic construct
  source 1..20: mol_type = other DNA
gaaaaaggtaatgaacaaat

SEQ ID NO: 631 - DNA, 20 bp, synthetic construct
  source 1..20: mol_type = other DNA
caagtgtatgaaaagtttaa

SEQ ID NO: 632 - DNA, 20 bp, synthetic construct
  source 1..20: mol_type = other DNA
atcaattcaagtgtatgaaa

SEQ ID NO: 633 - DNA, 20 bp, synthetic construct
  source 1..20: mol_type = other DNA
tcatcaattcaagtgtatga

SEQ ID NO: 634 - DNA, 20 bp, synthetic construct
  source 1..20: mol_type = other DNA
ctcatcaattcaagtgtatg

SEQ ID NO: 635 - DNA, 20 bp, synthetic construct
  source 1..20: mol_type = other DNA
agctcatcaattcaagtgta

SEQ ID NO: 636 - DNA, 20 bp, synthetic construct
  source 1..20: mol_type = other DNA
gtagctcatcaattcaagtg

SEQ ID NO: 637 - DNA, 20 bp, synthetic construct
  source 1..20: mol_type = other DNA
ggtagctcatcaattcaagt

SEQ ID NO: 638 - DNA, 20 bp, synthetic construct
  source 1..20: mol_type = other DNA
aggtagctcatcaattcaag

SEQ ID NO: 639 - DNA, 20 bp, synthetic construct
  source 1..20: mol_type = other DNA
taggtagctcatcaattcaa

SEQ ID NO: 640 - DNA, 20 bp, synthetic construct
  source 1..20: mol_type = other DNA
ttaggtagctcatcaattca

SEQ ID NO: 641 - DNA, 20 bp, synthetic construct
  source 1..20: mol_type = other DNA
tattaggtagctcatcaatt

SEQ ID NO: 642 - DNA, 20 bp, synthetic construct
  source 1..20: mol_type = other DNA
tcatttttatattaggtagc

SEQ ID NO: 643 - DNA, 20 bp, synthetic construct
  source 1..20: mol_type = other DNA
ctcatttttatattaggtag

SEQ ID NO: 644 - DNA, 20 bp, synthetic construct
  source 1..20: mol_type = other DNA
tctcatttttatattaggta

SEQ ID NO: 645 - DNA, 20 bp, synthetic construct
  source 1..20: mol_type = other DNA
ttggttttctcatttttata

SEQ ID NO: 646 - DNA, 20 bp, synthetic construct
  source 1..20: mol_type = other DNA
attggttttctcatttttat

SEQ ID NO: 647 - DNA, 20 bp, synthetic construct
  source 1..20: mol_type = other DNA
tattggttttctcattttta

SEQ ID NO: 648 - DNA, 20 bp, synthetic construct
  source 1..20: mol_type = other DNA
atattggttttctcattttt

SEQ ID NO: 649 - DNA, 20 bp, synthetic construct
  source 1..20: mol_type = other DNA
catattggttttctcatttt

SEQ ID NO: 650 - DNA, 20 bp, synthetic construct
  source 1..20: mol_type = other DNA
tgcatattggttttctcatt

SEQ ID NO: 651 - DNA, 20 bp, synthetic construct
  source 1..20: mol_type = other DNA
atgcatattggttttctcat

SEQ ID NO: 652 - DNA, 20 bp, synthetic construct
  source 1..20: mol_type = other DNA
aatgcatattggttttctca

SEQ ID NO: 653 - DNA, 20 bp, synthetic construct
  source 1..20: mol_type = other DNA
aaaatgcatattggttttct

SEQ ID NO: 654 - DNA, 20 bp, synthetic construct
  source 1..20: mol_type = other DNA
tatatatgaactttataaac

SEQ ID NO: 655 - DNA, 20 bp, synthetic construct
  source 1..20: mol_type = other DNA
gggtatatatgaactttata

SEQ ID NO: 656 - DNA, 20 bp, synthetic construct
  source 1..20: mol_type = other DNA
ctagggtatatatgaacttt

SEQ ID NO: 657 - DNA, 20 bp, synthetic construct
  source 1..20: mol_type = other DNA
actagggtatatatgaactt

SEQ ID NO: 658 - DNA, 20 bp, synthetic construct
  source 1..20: mol_type = other DNA
aactagggtatatatgaact

SEQ ID NO: 659 - DNA, 20 bp, synthetic construct
  source 1..20: mol_type = other DNA
aagtgctttaactagggtat

SEQ ID NO: 660 - DNA, 20 bp, synthetic construct
  source 1..20: mol_type = other DNA
taagtgctttaactagggta

SEQ ID NO: 661 - DNA, 20 bp, synthetic construct
  source 1..20: mol_type = other DNA
ttaagtgctttaactagggt

SEQ ID NO: 662 - DNA, 20 bp, synthetic construct
  source 1..20: mol_type = other DNA
ttttcttaagtgctttaact

SEQ ID NO: 663 - DNA, 20 bp, synthetic construct
  source 1..20: mol_type = other DNA
gccatattttcttaagtgct

SEQ ID NO: 664 - DNA, 20 bp, synthetic construct
  source 1..20: mol_type = other DNA
actaaaagtcaaacatgcca

SEQ ID NO: 665 - DNA, 20 bp, synthetic construct
  source 1..20: mol_type = other DNA
gaactaaaagtcaaacatgc

SEQ ID NO: 666 - DNA, 20 bp, synthetic construct
  source 1..20: mol_type = other DNA
gctctgctttaaaaactctc

SEQ ID NO: 667 - DNA, 20 bp, synthetic construct
  source 1..20: mol_type = other DNA
cacattcaaacgcatccagt

SEQ ID NO: 668 - DNA, 20 bp, synthetic construct
  source 1..20: mol_type = other DNA
acacattcaaacgcatccag

SEQ ID NO: 669 - DNA, 20 bp, synthetic construct
  source 1..20: mol_type = other DNA
caaacacattcaaacgcatc

SEQ ID NO: 670 - DNA, 20 bp, synthetic construct
  source 1..20: mol_type = other DNA
cacaaacacattcaaacgca

SEQ ID NO: 671 - DNA, 20 bp, synthetic construct
  source 1..20: mol_type = other DNA
tacacaaacacattcaaacg

SEQ ID NO: 672 - DNA, 20 bp, synthetic construct
  source 1..20: mol_type = other DNA
ctacacaaacacattcaaac

SEQ ID NO: 673 - DNA, 20 bp, synthetic construct
  source 1..20: mol_type = other DNA
actacacaaacacattcaaa

SEQ ID NO: 674 - DNA, 20 bp, synthetic construct
  source 1..20: mol_type = other DNA
caaactacacaaacacattc

SEQ ID NO: 675 - DNA, 20 bp, synthetic construct
  source 1..20: mol_type = other DNA
acaaactacacaaacacatt

SEQ ID NO: 676 - DNA, 20 bp, synthetic construct
  source 1..20: mol_type = other DNA
aacaaactacacaaacacat

SEQ ID NO: 677 - DNA, 20 bp, synthetic construct
  source 1..20: mol_type = other DNA
cacaacaaactacacaaaca

SEQ ID NO: 678 - DNA, 20 bp, synthetic construct
  source 1..20: mol_type = other DNA
tcacaacaaactacacaaac

SEQ ID NO: 679 - DNA, 20 bp, synthetic construct
  source 1..20: mol_type = other DNA
ttcacaacaaactacacaaa

SEQ ID NO: 680 - DNA, 20 bp, synthetic construct
  source 1..20: mol_type = other DNA
atttcacaacaaactacaca

SEQ ID NO: 681 - DNA, 20 bp, synthetic construct
  source 1..20: mol_type = other DNA
aatttcacaacaaactacac

SEQ ID NO: 682 - DNA, 20 bp, synthetic construct
  source 1..20: mol_type = other DNA
caatttcacaacaaactaca

SEQ ID NO: 683 - DNA, 20 bp, synthetic construct
  source 1..20: mol_type = other DNA
taacaatttcacaacaaact

SEQ ID NO: 684 - DNA, 20 bp, synthetic construct
  source 1..20: mol_type = other DNA
gtaacaatttcacaacaaac

SEQ ID NO: 685 - DNA, 20 bp, synthetic construct
  source 1..20: mol_type = other DNA
tgtaacaatttcacaacaaa

SEQ ID NO: 686 - DNA, 20 bp, synthetic construct
  source 1..20: mol_type = other DNA
atgtaacaatttcacaacaa

SEQ ID NO: 687 - DNA, 20 bp, synthetic construct
  source 1..20: mol_type = other DNA
aatgtaacaatttcacaaca

SEQ ID NO: 688 - DNA, 20 bp, synthetic construct
  source 1..20: mol_type = other DNA
aaatgtaacaatttcacaac

SEQ ID NO: 689 - DNA, 20 bp, synthetic construct
  source 1..20: mol_type = other DNA
taaatgtaacaatttcacaa

SEQ ID NO: 690 - DNA, 20 bp, synthetic construct
  source 1..20: mol_type = other DNA
ctaaatgtaacaatttcaca

SEQ ID NO: 691 - DNA, 20 bp, synthetic construct
  source 1..20: mol_type = other DNA
gctaaatgtaacaatttcac

SEQ ID NO: 692 - DNA, 20 bp, synthetic construct
  source 1..20: mol_type = other DNA
tgcctgctaaatgtaacaat

SEQ ID NO: 693 - DNA, 20 bp, synthetic construct
  source 1..20: mol_type = other DNA
tggatctgcctgctaaatgt

SEQ ID NO: 694 - DNA, 20 bp, synthetic construct
  source 1..20: mol_type = other DNA
caaccccaccaagatgacag

SEQ ID NO: 695 - DNA, 20 bp, synthetic construct
  source 1..20: mol_type = other DNA
taagccaaccccaccaagat

SEQ ID NO: 696 - DNA, 20 bp, synthetic construct
  source 1..20: mol_type = other DNA
ttaagccaaccccaccaaga

SEQ ID NO: 697 - DNA, 20 bp, synthetic construct
  source 1..20: mol_type = other DNA
aaatttaagccaaccccacc

SEQ ID NO: 698 - DNA, 20 bp, synthetic construct
  source 1..20: mol_type = other DNA
taaatttaagccaaccccac

SEQ ID NO: 699 - DNA, 20 bp, synthetic construct
  source 1..20: mol_type = other DNA
gtcaattaaatttaagccaa

SEQ ID NO: 700 - DNA, 20 bp, synthetic construct
  source 1..20: mol_type = other DNA
acagtcaattaaatttaagc

SEQ ID NO: 701 - DNA, 20 bp, synthetic construct
  source 1..20: mol_type = other DNA
gaatctaaacagtcaattaa

SEQ ID NO: 702 - DNA, 20 bp, synthetic construct
  source 1..20: mol_type = other DNA
aatggaatctaaacagtcaa

SEQ ID NO: 703 - DNA, 20 bp, synthetic construct
  source 1..20: mol_type = other DNA
tactggccaatcaattaaga

SEQ ID NO: 704 - DNA, 20 bp, synthetic construct
  source 1..20: mol_type = other DNA
ttcatactggccaatcaatt

SEQ ID NO: 705 - DNA, 20 bp, synthetic construct
  source 1..20: mol_type = other DNA
ttttcatactggccaatcaa

SEQ ID NO: 706 - DNA, 20 bp, synthetic construct
  source 1..20: mol_type = other DNA
tcttttcatactggccaatc

SEQ ID NO: 707 - DNA, 20 bp, synthetic construct
  source 1..20: mol_type = other DNA
atcttttcatactggccaat

SEQ ID NO: 708 - DNA, 20 bp, synthetic construct
  source 1..20: mol_type = other DNA
catcttttcatactggccaa

SEQ ID NO: 709 - DNA, 20 bp, synthetic construct
  source 1..20: mol_type = other DNA
gcatcttttcatactggcca

SEQ ID NO: 710 - DNA, 20 bp, synthetic construct
  source 1..20: mol_type = other DNA
ggcatcttttcatactggcc

SEQ ID NO: 711 - DNA, 20 bp, synthetic construct
  source 1..20: mol_type = other DNA
tggcatcttttcatactggc

SEQ ID NO: 712 - DNA, 20 bp, synthetic construct
  source 1..20: mol_type = other DNA
ctggcatcttttcatactgg

SEQ ID NO: 713 - DNA, 20 bp, synthetic construct
  source 1..20: mol_type = other DNA
cactggcatcttttcatact

SEQ ID NO: 714 - DNA, 20 bp, synthetic construct
  source 1..20: mol_type = other DNA
tactatggttacttgcactg

SEQ ID NO: 715 - DNA, 20 bp, synthetic construct
  source 1..20: mol_type = other DNA
tatagctttgaataattttt

SEQ ID NO: 716 - DNA, 20 bp, synthetic construct
  source 1..20: mol_type = other DNA
atgtataaactatagctttg

SEQ ID NO: 717 - DNA, 20 bp, synthetic construct
  source 1..20: mol_type = other DNA
tgatgtataaactatagctt

SEQ ID NO: 718 - DNA, 20 bp, synthetic construct
  source 1..20: mol_type = other DNA
gtacctgatgtataaactat

SEQ ID NO: 719 - DNA, 20 bp, synthetic construct
  source 1..20: mol_type = other DNA
cagtacctgatgtataaact

SEQ ID NO: 720 - DNA, 20 bp, synthetic construct
  source 1..20: mol_type = other DNA
gcagtacctgatgtataaac

SEQ ID NO: 721 - DNA, 20 bp, synthetic construct
  source 1..20: mol_type = other DNA
ggcagtacctgatgtataaa

SEQ ID NO: 722 - DNA, 20 bp, synthetic construct
  source 1..20: mol_type = other DNA
tggcagtacctgatgtataa

SEQ ID NO: 723 - DNA, 20 bp, synthetic construct
  source 1..20: mol_type = other DNA
atggcagtacctgatgtata

SEQ ID NO: 724 - DNA, 20 bp, synthetic construct
  source 1..20: mol_type = other DNA
aatggcagtacctgatgtat

SEQ ID NO: 725 - DNA, 20 bp, synthetic construct
  source 1..20: mol_type = other DNA
aaatggcagtacctgatgta

SEQ ID NO: 726 - DNA, 20 bp, synthetic construct
  source 1..20: mol_type = other DNA
gtaaatggcagtacctgatg

SEQ ID NO: 727 - DNA, 20 bp, synthetic construct
  source 1..20: mol_type = other DNA
gtttacagtaaatggcagta

SEQ ID NO: 728 - DNA, 20 bp, synthetic construct
  source 1..20: mol_type = other DNA
tggtttacagtaaatggcag

SEQ ID NO: 729 - DNA, 20 bp, synthetic construct
  source 1..20: mol_type = other DNA
ggtggtttacagtaaatggc

SEQ ID NO: 730 - DNA, 20 bp, synthetic construct
  source 1..20: mol_type = other DNA
aggtggtttacagtaaatgg

SEQ ID NO: 731 - DNA, 20 bp, synthetic construct
  source 1..20: mol_type = other DNA
gcaggtggtttacagtaaat

SEQ ID NO: 732 - DNA, 20 bp, synthetic construct
  source 1..20: mol_type = other DNA
ctgactttcttgcaggtggt

SEQ ID NO: 733 - DNA, 20 bp, synthetic construct
  source 1..20: mol_type = other DNA
ttcctgactttcttgcaggt

SEQ ID NO: 734 - DNA, 20 bp, synthetic construct
  source 1..20: mol_type = other DNA
gttcctgactttcttgcagg

SEQ ID NO: 735 - DNA, 20 bp, synthetic construct
  source 1..20: mol_type = other DNA
ttgttcctgactttcttgca

SEQ ID NO: 736 - DNA, 20 bp, synthetic construct
  source 1..20: mol_type = other DNA
tagttgttcctgactttctt

SEQ ID NO: 737 - DNA, 20 bp, synthetic construct
  source 1..20: mol_type = other DNA
tttagttgttcctgactttc

SEQ ID NO: 738 - DNA, 20 bp, synthetic construct
  source 1..20: mol_type = other DNA
aatggaaatctttaatacac

SEQ ID NO: 739 - DNA, 20 bp, synthetic construct
  source 1..20: mol_type = other DNA
ccaattagtaaaacaaaatg

SEQ ID NO: 740 - DNA, 20 bp, synthetic construct
  source 1..20: mol_type = other DNA
gatgttcccaattagtaaaa

SEQ ID NO: 741 - DNA, 20 bp, synthetic construct
  source 1..20: mol_type = other DNA
aagatgttcccaattagtaa

SEQ ID NO: 742 - DNA, 20 bp, synthetic construct
  source 1..20: mol_type = other DNA
taagatgttcccaattagta

SEQ ID NO: 743 - DNA, 20 bp, synthetic construct
  source 1..20: mol_type = other DNA
aaacattaagatgttcccaa

SEQ ID NO: 744 - DNA, 20 bp, synthetic construct
  source 1..20: mol_type = other DNA
taaacattaagatgttccca

SEQ ID NO: 745 - DNA, 20 bp, synthetic construct
  source 1..20: mol_type = other DNA
attaaacattaagatgttcc

SEQ ID NO: 746 - DNA, 20 bp, synthetic construct
  source 1..20: mol_type = other DNA
tattaaacattaagatgttc

SEQ ID NO: 747 - DNA, 20 bp, synthetic construct
  source 1..20: mol_type = other DNA
atattaaacattaagatgtt

SEQ ID NO: 748 - DNA, 20 bp, synthetic construct
  source 1..20: mol_type = other DNA
aaatattaaacattaagatg

SEQ ID NO: 749 - DNA, 20 bp, synthetic construct
  source 1..20: mol_type = other DNA
taaatattaaacattaagat

SEQ ID NO: 750 - DNA, 20 bp, synthetic construct
  source 1..20: mol_type = other DNA
atagtttaaatattaaacat

SEQ ID NO: 751 - DNA, 20 bp, synthetic construct
  source 1..20: mol_type = other DNA
caatagtttaaatattaaac

SEQ ID NO: 752 - DNA, 20 bp, synthetic construct
  source 1..20: mol_type = other DNA
ccaatagtttaaatattaaa

SEQ ID NO: 753 - DNA, 20 bp, synthetic construct
  source 1..20: mol_type = other DNA
accaatagtttaaatattaa

SEQ ID NO: 754 - DNA, 20 bp, synthetic construct
  source 1..20: mol_type = other DNA
ataccaatagtttaaatatt

SEQ ID NO: 755 - DNA, 20 bp, synthetic construct
  source 1..20: mol_type = other DNA
aaaatgataccaatagttta

SEQ ID NO: 756 - DNA, 20 bp, synthetic construct
  source 1..20: mol_type = other DNA
aaaaatgataccaatagttt

SEQ ID NO: 757 - DNA, 20 bp, synthetic construct
  source 1..20: mol_type = other DNA
gaaaaatgataccaatagtt

SEQ ID NO: 758 - DNA, 20 bp, synthetic construct
  source 1..20: mol_type = other DNA
agaaaaatgataccaatagt

SEQ ID NO: 759 - DNA, 20 bp, synthetic construct
  source 1..20: mol_type = other DNA
tagaaaaatgataccaatag

SEQ ID NO: 760 - DNA, 20 bp, synthetic construct
  source 1..20: mol_type = other DNA
attagaaaaatgataccaat

SEQ ID NO: 761 - DNA, 20 bp, synthetic construct
  source 1..20: mol_type = other DNA
cattagaaaaatgataccaa

SEQ ID NO: 762 - DNA, 20 bp, synthetic construct
  source 1..20: mol_type = other DNA
tacattagaaaaatgatacc

SEQ ID NO: 763 - DNA, 20 bp, synthetic construct
  source 1..20: mol_type = other DNA
atacattagaaaaatgatac

SEQ ID NO: 764 - DNA, 20 bp, synthetic construct
  source 1..20: mol_type = other DNA
tatacattagaaaaatgata

SEQ ID NO: 765 - DNA, 20 bp, synthetic construct
  source 1..20: mol_type = other DNA
caaattatacattagaaaaa

SEQ ID NO: 766 - DNA, 20 bp, synthetic construct
  source 1..20: mol_type = other DNA
acaaattatacattagaaaa

SEQ ID NO: 767 - DNA, 20 bp, synthetic construct
  source 1..20: mol_type = other DNA
tacaaattatacattagaaa

SEQ ID NO: 768 - DNA, 20 bp, synthetic construct
  source 1..20: mol_type = other DNA
atacaaattatacattagaa

SEQ ID NO: 769 - DNA, 20 bp, synthetic construct
  source 1..20: mol_type = other DNA
aatacaaattatacattaga

SEQ ID NO: 770 - DNA, 20 bp, synthetic construct
  source 1..20: mol_type = other DNA
taatacaaattatacattag

SEQ ID NO: 771 - DNA, 20 bp, synthetic construct
  source 1..20: mol_type = other DNA
agtaatacaaattatacatt

SEQ ID NO: 772 - DNA, 20 bp, synthetic construct
  source 1..20: mol_type = other DNA
cccagtaatacaaattatac

SEQ ID NO: 773 - DNA, 20 bp, synthetic construct
  source 1..20: mol_type = other DNA
tcccagtaatacaaattata

SEQ ID NO: 774 - DNA, 20 bp, synthetic construct
  source 1..20: mol_type = other DNA
atcccagtaatacaaattat

SEQ ID NO: 775 - DNA, 20 bp, synthetic construct
  source 1..20: mol_type = other DNA
gatcccagtaatacaaatta

SEQ ID NO: 776 - DNA, 20 bp, synthetic construct
  source 1..20: mol_type = other DNA
acttgatcccagtaatacaa

SEQ ID NO: 777 - DNA, 20 bp, synthetic construct
  source 1..20: mol_type = other DNA
tacttgatcccagtaataca

SEQ ID NO: 778 - DNA, 20 bp, synthetic construct
  source 1..20: mol_type = other DNA
atacttgatcccagtaatac

SEQ ID NO: 779 - DNA, 20 bp, synthetic construct
  source 1..20: mol_type = other DNA
catacttgatcccagtaata

SEQ ID NO: 780 - DNA, 20 bp, synthetic construct
  source 1..20: mol_type = other DNA
gtacatacttgatcccagta

SEQ ID NO: 781 - DNA, 20 bp, synthetic construct
  source 1..20: mol_type = other DNA
ctgtacatacttgatcccag

SEQ ID NO: 782 - DNA, 20 bp, synthetic construct
  source 1..20: mol_type = other DNA
accactgtacatacttgatc

SEQ ID NO: 783 - DNA, 20 bp, synthetic construct
  source 1..20: mol_type = other DNA
caccactgtacatacttgat

SEQ ID NO: 784 - DNA, 20 bp, synthetic construct
  source 1..20: mol_type = other DNA
agcatcaccactgtacatac

SEQ ID NO: 785 - DNA, 20 bp, synthetic construct
  source 1..20: mol_type = other DNA
tagcatcaccactgtacata

SEQ ID NO: 786 - DNA, 20 bp, synthetic construct
  source 1..20: mol_type = other DNA
actagcatcaccactgtaca

SEQ ID NO: 787 - DNA, 20 bp, synthetic construct
  source 1..20: mol_type = other DNA
tactagcatcaccactgtac

SEQ ID NO: 788 - DNA, 20 bp, synthetic construct
  source 1..20: mol_type = other DNA
ttaaacttctactagcatca

SEQ ID NO: 789 - DNA, 20 bp, synthetic construct
  source 1..20: mol_type = other DNA
aggcttaaacttctactagc

SEQ ID NO: 790 - DNA, 20 bp, synthetic construct
  source 1..20: mol_type = other DNA
tccaaggcttaaacttctac

SEQ ID NO: 791 - DNA, 20 bp, synthetic construct
  source 1..20: mol_type = other DNA
agtggtatttccaaggctta

SEQ ID NO: 792 - DNA, 20 bp, synthetic construct
  source 1..20: mol_type = other DNA
aagtggtatttccaaggctt

SEQ ID NO: 793 - DNA, 20 bp, synthetic construct
  source 1..20: mol_type = other DNA
aaagtggtatttccaaggct

SEQ ID NO: 794 - DNA, 20 bp, synthetic construct
  source 1..20: mol_type = other DNA
tgaaaatatgaaagtggtat

SEQ ID NO: 795 - DNA, 20 bp, synthetic construct
  source 1..20: mol_type = other DNA
ctgaaaatatgaaagtggta

SEQ ID NO: 796 - DNA, 20 bp, synthetic construct
  source 1..20: mol_type = other DNA
catctgaaaatatgaaagtg

SEQ ID NO: 797 - DNA, 20 bp, synthetic construct
  source 1..20: mol_type = other DNA
acatctgaaaatatgaaagt

SEQ ID NO: 798 - DNA, 20 bp, synthetic construct
  source 1..20: mol_type = other DNA
gacatctgaaaatatgaaag

SEQ ID NO: 799 - DNA, 20 bp, synthetic construct
  source 1..20: mol_type = other DNA
tgacatctgaaaatatgaaa

SEQ ID NO: 800 - DNA, 20 bp, synthetic construct
  source 1..20: mol_type = other DNA
atgacatctgaaaatatgaa

SEQ ID NO: 801 - DNA, 20 bp, synthetic construct
  source 1..20: mol_type = other DNA
taaatccatgacatctgaaa

SEQ ID NO: 802 - DNA, 20 bp, synthetic construct
  source 1..20: mol_type = other DNA
cattaaatccatgacatctg

SEQ ID NO: 803 - DNA, 20 bp, synthetic construct
  source 1..20: mol_type = other DNA
tcattaaatccatgacatct

SEQ ID NO: 804 - DNA, 20 bp, synthetic construct
  source 1..20: mol_type = other DNA
ctcattaaatccatgacatc

SEQ ID NO: 805 - DNA, 20 bp, synthetic construct
  source 1..20: mol_type = other DNA
tactcattaaatccatgaca

SEQ ID NO: 806 - DNA, 20 bp, synthetic construct
  source 1..20: mol_type = other DNA
attactcattaaatccatga

SEQ ID NO: 807 - DNA, 20 bp, synthetic construct
  source 1..20: mol_type = other DNA
aaattactcattaaatccat

SEQ ID NO: 808 - DNA, 20 bp, synthetic construct
  source 1..20: mol_type = other DNA
taaattactcattaaatcca

SEQ ID NO: 809 - DNA, 20 bp, synthetic construct
  source 1..20: mol_type = other DNA
ataaattactcattaaatcc

SEQ ID NO: 810 - DNA, 20 bp, synthetic construct
  source 1..20: mol_type = other DNA
cataaattactcattaaatc

SEQ ID NO: 811 - DNA, 20 bp, synthetic construct
  source 1..20: mol_type = other DNA
acataaattactcattaaat

SEQ ID NO: 812 - DNA, 20 bp, synthetic construct
  source 1..20: mol_type = other DNA
aacataaattactcattaaa

SEQ ID NO: 813 - DNA, 20 bp, synthetic construct
  source 1..20: mol_type = other DNA
aaacataaattactcattaa

SEQ ID NO: 814 - DNA, 20 bp, synthetic construct
  source 1..20: mol_type = other DNA
aaaacataaattactcatta

SEQ ID NO: 815 - DNA, 20 bp, synthetic construct
  source 1..20: mol_type = other DNA
aaaaacataaattactcatt

SEQ ID NO: 816 - DNA, 20 bp, synthetic construct
  source 1..20: mol_type = other DNA
agattaactattctgaattt

SEQ ID NO: 817 - DNA, 20 bp, synthetic construct
  source 1..20: mol_type = other DNA
gagattaactattctgaatt

SEQ ID NO: 818 - DNA, 20 bp, synthetic construct
  source 1..20: mol_type = other DNA
agagattaactattctgaat

SEQ ID NO: 819 - DNA, 20 bp, synthetic construct
  source 1..20: mol_type = other DNA
cagagattaactattctgaa

SEQ ID NO: 820 - DNA, 20 bp, synthetic construct
  source 1..20: mol_type = other DNA
tcagagattaactattctga

SEQ ID NO: 821 - DNA, 20 bp, synthetic construct
  source 1..20: mol_type = other DNA
agatcagagattaactattc

SEQ ID NO: 822 - DNA, 20 bp, synthetic construct
  source 1..20: mol_type = other DNA
tagatcagagattaactatt

SEQ ID NO: 823 - DNA, 20 bp, synthetic construct
  source 1..20: mol_type = other DNA
ggttttagatcagagattaa

SEQ ID NO: 824 - DNA, 20 bp, synthetic construct
  source 1..20: mol_type = other DNA
tggttttagatcagagatta

SEQ ID NO: 825 - DNA, 20 bp, synthetic construct
  source 1..20: mol_type = other DNA
atggttttagatcagagatt

SEQ ID NO: 826 - DNA, 20 bp, synthetic construct
  source 1..20: mol_type = other DNA
tgatggttttagatcagaga

SEQ ID NO: 827 - DNA, 20 bp, synthetic construct
  source 1..20: mol_type = other DNA
accgtaaaaaacatagattg

SEQ ID NO: 828 - DNA, 20 bp, synthetic construct
  source 1..20: mol_type = other DNA
ttaccgtaaaaaacatagat

SEQ ID NO: 829 - DNA, 20 bp, synthetic construct
  source 1..20: mol_type = other DNA
actgaaatatttacatgatt

SEQ ID NO: 830 - DNA, 20 bp, synthetic construct
  source 1..20: mol_type = other DNA
gtttatattactgaaatatt

SEQ ID NO: 831 - DNA, 20 bp, synthetic construct
  source 1..20: mol_type = other DNA
acagtttatattactgaaat

SEQ ID NO: 832 - DNA, 20 bp, synthetic construct
  source 1..20: mol_type = other DNA
aacagtttatattactgaaa

SEQ ID NO: 833 - DNA, 20 bp, synthetic construct
  source 1..20: mol_type = other DNA
aaacagtttatattactgaa

SEQ ID NO: 834 - DNA, 20 bp, synthetic construct
  source 1..20: mol_type = other DNA
caaacagtttatattactga

SEQ ID NO: 835 - DNA, 20 bp, synthetic construct
  source 1..20: mol_type = other DNA
tcaaacagtttatattactg

SEQ ID NO: 836 - DNA, 20 bp, synthetic construct
  source 1..20: mol_type = other DNA
tttcaaacagtttatattac

SEQ ID NO: 837 - DNA, 20 bp, synthetic construct
  source 1..20: mol_type = other DNA
ccttttcaaacagtttatat

SEQ ID NO: 838 - DNA, 20 bp, synthetic construct
  source 1..20: mol_type = other DNA
gccttttcaaacagtttata

SEQ ID NO: 839 - DNA, 20 bp, synthetic construct
  source 1..20: mol_type = other DNA
gcagccttttcaaacagttt

SEQ ID NO: 840 - DNA, 20 bp, synthetic construct
  source 1..20: mol_type = other DNA
cagcagccttttcaaacagt

SEQ ID NO: 841 - DNA, 20 bp, synthetic construct
  source 1..20: mol_type = other DNA
tgcagcagccttttcaaaca

SEQ ID NO: 842 - DNA, 20 bp, synthetic construct
  source 1..20: mol_type = other DNA
agagtttacctgcagcagcc

SEQ ID NO: 843 - DNA, 20 bp, synthetic construct
  source 1..20: mol_type = other DNA
atagagtttacctgcagcag

SEQ ID NO: 844 - DNA, 20 bp, synthetic construct
  source 1..20: mol_type = other DNA
tatagagtttacctgcagca

SEQ ID NO: 845 - DNA, 20 bp, synthetic construct
  source 1..20: mol_type = other DNA
gtatagagtttacctgcagc

SEQ ID NO: 846 - DNA, 20 bp, synthetic construct
  source 1..20: mol_type = other DNA
tagtatagagtttacctgca

SEQ ID NO: 847 - DNA, 20 bp, synthetic construct
  source 1..20: mol_type = other DNA
attgtaaattatttggccaa

SEQ ID NO: 848 - DNA, 20 bp, synthetic construct
  source 1..20: mol_type = other DNA
aattgtaaattatttggcca

SEQ ID NO: 849 - DNA, 20 bp, synthetic construct
  source 1..20: mol_type = other DNA
gaattgtaaattatttggcc

SEQ ID NO: 850 - DNA, 20 bp, synthetic construct
  source 1..20: mol_type = other DNA
tgaattgtaaattatttggc

SEQ ID NO: 851 - DNA, 20 bp, synthetic construct
  source 1..20: mol_type = other DNA
gtgaattgtaaattatttgg

SEQ ID NO: 852 - DNA, 20 bp, synthetic construct
  source 1..20: mol_type = other DNA
attctgtgaattgtaaatta

SEQ ID NO: 853 - DNA, 20 bp, synthetic construct
  source 1..20: mol_type = other DNA
ccttaaataaaatattctgt

SEQ ID NO: 854 - DNA, 20 bp, synthetic construct
  source 1..20: mol_type = other DNA
gcaccaccttaaataaaata

SEQ ID NO: 855 - DNA, 20 bp, synthetic construct
  source 1..20: mol_type = other DNA
aaagcaccaccttaaataaa

SEQ ID NO: 856 - DNA, 20 bp, synthetic construct
  source 1..20: mol_type = other DNA
atcaagttttaaggacaaaa

SEQ ID NO: 857 - DNA, 20 bp, synthetic construct
  source 1..20: mol_type = other DNA
aaatcaagttttaaggacaa

SEQ ID NO: 858 - DNA, 20 bp, synthetic construct
  source 1..20: mol_type = other DNA
aaaatcaagttttaaggaca

SEQ ID NO: 859 - DNA, 20 bp, synthetic construct
  source 1..20: mol_type = other DNA
aaaaatcaagttttaaggac

SEQ ID NO: 860 - DNA, 20 bp, synthetic construct
  source 1..20: mol_type = other DNA
aagttaagaaaaatcaagtt

SEQ ID NO: 861 - DNA, 20 bp, synthetic construct
  source 1..20: mol_type = other DNA
ctttggcatcatgaataaag

SEQ ID NO: 862 - DNA, 20 bp, synthetic construct
  source 1..20: mol_type = other DNA
aatattaaacaatatggact

SEQ ID NO: 863 - DNA, 20 bp, synthetic construct
  source 1..20: mol_type = other DNA
ttaatattaaacaatatgga

SEQ ID NO: 864 - DNA, 20 bp, synthetic construct
  source 1..20: mol_type = other DNA
acttaatattaaacaatatg

SEQ ID NO: 865 - DNA, 20 bp, synthetic construct
  source 1..20: mol_type = other DNA
aacttaatattaaacaatat

SEQ ID NO: 866 - DNA, 20 bp, synthetic construct
  source 1..20: mol_type = other DNA
ttttattcaacttaatatta

SEQ ID NO: 867 - DNA, 20 bp, synthetic construct
  source 1..20: mol_type = other DNA
taaaatttattttattcaac

SEQ ID NO: 868 - DNA, 20 bp, synthetic construct
  source 1..20: mol_type = other DNA
caaaatgtgatttaggctct

SEQ ID NO: 869 - DNA, 20 bp, synthetic construct
  source 1..20: mol_type = other DNA
tcagacaatcaaaatgtgat

SEQ ID NO: 870 - DNA, 20 bp, synthetic construct
  source 1..20: mol_type = other DNA
tcaaaaattcagacaatcaa

SEQ ID NO: 871 - DNA, 20 bp, synthetic construct
  source 1..20: mol_type = other DNA
tatcaaaaattcagacaatc

SEQ ID NO: 872 - DNA, 20 bp, synthetic construct
  source 1..20: mol_type = other DNA
gtatcaaaaattcagacaat

SEQ ID NO: 873 - DNA, 20 bp, synthetic construct
  source 1..20: mol_type = other DNA
atagtatcaaaaattcagac

SEQ ID NO: 874 - DNA, 20 bp, synthetic construct
  source 1..20: mol_type = other DNA
ggttttaagaatttagtagc

SEQ ID NO: 875 - DNA, 20 bp, synthetic construct
  source 1..20: mol_type = other DNA
cggttttaagaatttagtag

SEQ ID NO: 876 - DNA, 20 bp, synthetic construct
  source 1..20: mol_type = other DNA
ggccggttttaagaatttag

SEQ ID NO: 877 - DNA, 20 bp, synthetic construct
  source 1..20: mol_type = other DNA
gaatctattttttatctgta

SEQ ID NO: 878 - DNA, 20 bp, synthetic construct
  source 1..20: mol_type = other DNA
aaaattatcatattttgatt

SEQ ID NO: 879 - DNA, 20 bp, synthetic construct
  source 1..20: mol_type = other DNA
taaaattatcatattttgat

SEQ ID NO: 880 - DNA, 20 bp, synthetic construct
  source 1..20: mol_type = other DNA
agattttaaaattatcatat

SEQ ID NO: 881 - DNA, 20 bp, synthetic construct
  source 1..20: mol_type = other DNA
cttaagattttaaaattatc

SEQ ID NO: 882 - DNA, 20 bp, synthetic construct
  source 1..20: mol_type = other DNA
ctacttaagattttaaaatt

SEQ ID NO: 883 - DNA, 20 bp, synthetic construct
  source 1..20: mol_type = other DNA
tatttttctacttaagattt

SEQ ID NO: 884 - DNA, 20 bp, synthetic construct
  source 1..20: mol_type = other DNA
tttatttttctacttaagat

SEQ ID NO: 885 - DNA, 20 bp, synthetic construct
  source 1..20: mol_type = other DNA
gatttatttttctacttaag

SEQ ID NO: 886 - DNA, 20 bp, synthetic construct
  source 1..20: mol_type = other DNA
atcaagatttatttttctac

SEQ ID NO: 887 - DNA, 20 bp, synthetic construct
  source 1..20: mol_type = other DNA
catcaagatttatttttcta

SEQ ID NO: 888 - DNA, 20 bp, synthetic construct
  source 1..20: mol_type = other DNA
aacatcaagatttatttttc

SEQ ID NO: 889 - DNA, 20 bp, synthetic construct
  source 1..20: mol_type = other DNA
atttaaaacatcaagattta

SEQ ID NO: 890 - DNA, 20 bp, synthetic construct
  source 1..20: mol_type = other DNA
taagaatttaaaacatcaag

SEQ ID NO: 891 - DNA, 20 bp, synthetic construct
  source 1..20: mol_type = other DNA
gtaagaatttaaaacatcaa

SEQ ID NO: 892 - DNA, 20 bp, synthetic construct
  source 1..20: mol_type = other DNA
caatattaactattgaatcc

SEQ ID NO: 893 - DNA, 20 bp, synthetic construct
  source 1..20: mol_type = other DNA
ataaagtttttaataggaag

SEQ ID NO: 894 - DNA, 20 bp, synthetic construct
  source 1..20: mol_type = other DNA
ggataaagtttttaatagga

SEQ ID NO: 895 - DNA, 20 bp, synthetic construct
  source 1..20: mol_type = other DNA
caaacaaacctttaagatgg

SEQ ID NO: 896 - DNA, 20 bp, synthetic construct
  source 1..20: mol_type = other DNA
acaaacaaacctttaagatg

SEQ ID NO: 897 - DNA, 20 bp, synthetic construct
  source 1..20: mol_type = other DNA
tttccggattaaaaaaaaac

SEQ ID NO: 898 - DNA, 20 bp, synthetic construct
  source 1..20: mol_type = other DNA
aaaaaaaacaaatattcgcc

SEQ ID NO: 899 - DNA, 20 bp, synthetic construct
  source 1..20: mol_type = other DNA
taaaaaaaacaaatattcgc

SEQ ID NO: 900 - DNA, 20 bp, synthetic construct
  source 1..20: mol_type = other DNA
aaacaattcactttgaaaac

SEQ ID NO: 901 - DNA, 20 bp, synthetic construct
  source 1..20: mol_type = other DNA
aacaaacaattcactttgaa

SEQ ID NO: 902 - DNA, 20 bp, synthetic construct
  source 1..20: mol_type = other DNA
caacaaacaattcactttga

SEQ ID NO: 903 - DNA, 20 bp, synthetic construct
  source 1..20: mol_type = other DNA
acaacaaacaattcactttg

SEQ ID NO: 904 - DNA, 20 bp, synthetic construct
  source 1..20: mol_type = other DNA
tacaacaaacaattcacttt

SEQ ID NO: 905 - DNA, 20 bp, synthetic construct
  source 1..20: mol_type = other DNA
atacaacaaacaattcactt

SEQ ID NO: 906 - DNA, 20 bp, synthetic construct
  source 1..20: mol_type = other DNA
gatacaacaaacaattcact

SEQ ID NO: 907 - DNA, 20 bp, synthetic construct
  source 1..20: mol_type = other DNA
ctcgatacaacaaacaattc

SEQ ID NO: 908 - DNA, 20 bp, synthetic construct
  source 1..20: mol_type = other DNA
gactcgatacaacaaacaat

SEQ ID NO: 909 - DNA, 20 bp, synthetic construct
  source 1..20: mol_type = other DNA
ggactcgatacaacaaacaa

SEQ ID NO: 910 - DNA, 20 bp, synthetic construct
  source 1..20: mol_type = other DNA
aggactcgatacaacaaaca

SEQ ID NO: 911 - DNA, 20 bp, synthetic construct
  source 1..20: mol_type = other DNA
aaggactcgatacaacaaac

SEQ ID NO: 912 - DNA, 20 bp, synthetic construct
  source 1..20: mol_type = other DNA
ttaaggactcgatacaacaa

SEQ ID NO: 913 - DNA, 20 bp, synthetic construct
  source 1..20: mol_type = other DNA
tatatccatacttaaggact

SEQ ID NO: 914 - DNA, 20 bp, synthetic construct
  source 1..20: mol_type = other DNA
gggtcacatatatatccata

SEQ ID NO: 915 - DNA, 20 bp, synthetic construct
  source 1..20: mol_type = other DNA
tagggtcacatatatatcca

SEQ ID NO: 916 - DNA, 20 bp, synthetic construct
  source 1..20: mol_type = other DNA
taattagggtcacatatata

SEQ ID NO: 917 - DNA, 20 bp, synthetic construct
  source 1..20: mol_type = other DNA
cttaattagggtcacatata

SEQ ID NO: 918 - DNA, 20 bp, synthetic construct
  source 1..20: mol_type = other DNA
tcttaattagggtcacatat

SEQ ID NO: 919 - DNA, 20 bp, synthetic construct
  source 1..20: mol_type = other DNA
ttcttaattagggtcacata

SEQ ID NO: 920 - DNA, 20 bp, synthetic construct
  source 1..20: mol_type = other DNA
gttcttaattagggtcacat

SEQ ID NO: 921 - DNA, 20 bp, synthetic construct
  source 1..20: mol_type = other DNA
agttcttaattagggtcaca

SEQ ID NO: 922 - DNA, 20 bp, synthetic construct
  source 1..20: mol_type = other DNA
tagttcttaattagggtcac

SEQ ID NO: 923 - DNA, 20 bp, synthetic construct
  source 1..20: mol_type = other DNA
gtagttcttaattagggtca

SEQ ID NO: 924 - DNA, 20 bp, synthetic construct
  source 1..20: mol_type = other DNA
tggtagttcttaattagggt

SEQ ID NO: 925 - DNA, 20 bp, synthetic construct
  source 1..20: mol_type = other DNA
attagttgatccaatctggt

SEQ ID NO: 926 - DNA, 20 bp, synthetic construct
  source 1..20: mol_type = other DNA
gattagttgatccaatctgg

SEQ ID NO: 927 - DNA, 20 bp, synthetic construct
  source 1..20: mol_type = other DNA
tgctgacatgattagttgat

SEQ ID NO: 928 - DNA, 20 bp, synthetic construct
  source 1..20: mol_type = other DNA
ttgctgacatgattagttga

SEQ ID NO: 929 - DNA, 20 bp, synthetic construct
  source 1..20: mol_type = other DNA
acattgctgacatgattagt

SEQ ID NO: 930 - DNA, 20 bp, synthetic construct
  source 1..20: mol_type = other DNA
aagttatttacattgctgac

SEQ ID NO: 931 - DNA, 20 bp, synthetic construct
  source 1..20: mol_type = other DNA
ataaagttatttacattgct

SEQ ID NO: 932 - DNA, 20 bp, synthetic construct
  source 1..20: mol_type = other DNA
aataaagttatttacattgc

SEQ ID NO: 933 - DNA, 20 bp, synthetic construct
  source 1..20: mol_type = other DNA
tgaatatgaaaaataaagtt

SEQ ID NO: 934 - DNA, 20 bp, synthetic construct
  source 1..20: mol_type = other DNA
agtttttattttgaatatga

SEQ ID NO: 935 - DNA, 20 bp, synthetic construct
  source 1..20: mol_type = other DNA
agaaagtttttattttgaat

SEQ ID NO: 936 - DNA, 20 bp, synthetic construct
  source 1..20: mol_type = other DNA
gtcattttttaaagcaaaaa

SEQ ID NO: 937 - DNA, 20 bp, synthetic construct
  source 1..20: mol_type = other DNA
caggtcattttttaaagcaa

SEQ ID NO: 938 - DNA, 20 bp, synthetic construct
  source 1..20: mol_type = other DNA
aaatacaaagccaggtcatt

SEQ ID NO: 939 - DNA, 20 bp, synthetic construct
  source 1..20: mol_type = other DNA
ctaaaaaaatacaaagccag

SEQ ID NO: 940 - DNA, 20 bp, synthetic construct
  source 1..20: mol_type = other DNA
actaaaaaaatacaaagcca

SEQ ID NO: 941 - DNA, 20 bp, synthetic construct
  source 1..20: mol_type = other DNA
atgtttaagactaaaaaaat

SEQ ID NO: 942 - DNA, 20 bp, synthetic construct
  source 1..20: mol_type = other DNA
gtcaataatcttcactcatg

SEQ ID NO: 943 - DNA, 20 bp, synthetic construct
  source 1..20: mol_type = other DNA
cgatgtcaataatcttcact

SEQ ID NO: 944 - DNA, 20 bp, synthetic construct
  source 1..20: mol_type = other DNA
atttaccaacgatgtcaata

SEQ ID NO: 945 - DNA, 20 bp, synthetic construct
  source 1..20: mol_type = other DNA
gaatttaccaacgatgtcaa

SEQ ID NO: 946 - DNA, 20 bp, synthetic construct
  source 1..20: mol_type = other DNA
ctagaatttaccaacgatgt

SEQ ID NO: 947 - DNA, 20 bp, synthetic construct
  source 1..20: mol_type = other DNA
aattctagaatttaccaacg

SEQ ID NO: 948 - DNA, 20 bp, synthetic construct
  source 1..20: mol_type = other DNA
aaattctagaatttaccaac

SEQ ID NO: 949 - DNA, 20 bp, synthetic construct
  source 1..20: mol_type = other DNA
aaaattctagaatttaccaa

SEQ ID NO: 950 - DNA, 20 bp, synthetic construct
  source 1..20: mol_type = other DNA
atcaaaattctagaatttac

SEQ ID NO: 951 - DNA, 20 bp, synthetic construct
  source 1..20: mol_type = other DNA
aaatcaaaattctagaattt

SEQ ID NO: 952 - DNA, 20 bp, synthetic construct
  source 1..20: mol_type = other DNA
caaaatcaaaattctagaat

SEQ ID NO: 953 - DNA, 20 bp, synthetic construct
  source 1..20: mol_type = other DNA
actaattcttaaaatgccag

SEQ ID NO: 954 - DNA, 20 bp, synthetic construct
  source 1..20: mol_type = other DNA
cactaattcttaaaatgcca

SEQ ID NO: 955 - DNA, 20 bp, synthetic construct
  source 1..20: mol_type = other DNA
ttacgacaaatttagaagtt

SEQ ID NO: 956 - DNA, 20 bp, synthetic construct
  source 1..20: mol_type = other DNA
acatgccaattacgacaaat

SEQ ID NO: 957 - DNA, 20 bp, synthetic construct
  source 1..20: mol_type = other DNA
atgctattaaacatgccaat

SEQ ID NO: 958 - DNA, 20 bp, synthetic construct
  source 1..20: mol_type = other DNA
atatgctattaaacatgcca

SEQ ID NO: 959 - DNA, 20 bp, synthetic construct
  source 1..20: mol_type = other DNA
gatatgctattaaacatgcc

SEQ ID NO: 960 - DNA, 20 bp, synthetic construct
  source 1..20: mol_type = other DNA
tgatatgctattaaacatgc

SEQ ID NO: 961 - DNA, 20 bp, synthetic construct
  source 1..20: mol_type = other DNA
atgttttttgatatgctatt

SEQ ID NO: 962 - DNA, 20 bp, synthetic construct
  source 1..20: mol_type = other DNA
aatgttttttgatatgctat

SEQ ID NO: 963 - DNA, 20 bp, synthetic construct
  source 1..20: mol_type = other DNA
aaatgttttttgatatgcta

SEQ ID NO: 964 - DNA, 20 bp, synthetic construct
  source 1..20: mol_type = other DNA
aaaatgttttttgatatgct

SEQ ID NO: 965 - DNA, 20 bp, synthetic construct
  source 1..20: mol_type = other DNA
ccacaggcttaaaatgtttt

SEQ ID NO: 966 - DNA, 20 bp, synthetic construct
  source 1..20: mol_type = other DNA
ctatgaatccacaggcttaa

SEQ ID NO: 967 - DNA, 20 bp, synthetic construct
  source 1..20: mol_type = other DNA
ctaatgtttctcattgcttt

SEQ ID NO: 968 - DNA, 20 bp, synthetic construct
  source 1..20: mol_type = other DNA
ccatttatattttactaatg

SEQ ID NO: 969 - DNA, 20 bp, synthetic construct
  source 1..20: mol_type = other DNA
tatccatttatattttacta

SEQ ID NO: 970 - DNA, 20 bp, synthetic construct
  source 1..20: mol_type = other DNA
ggaatatccatttatatttt

SEQ ID NO: 971 - DNA, 20 bp, synthetic construct
  source 1..20: mol_type = other DNA
agagcttcctaaatgcatca

SEQ ID NO: 972 - DNA, 20 bp, synthetic construct
  source 1..20: mol_type = other DNA
aaaacattccttgaactatg

SEQ ID NO: 973 - DNA, 20 bp, synthetic construct
  source 1..20: mol_type = other DNA
agaaaacattccttgaacta

SEQ ID NO: 974 - DNA, 20 bp, synthetic construct
  source 1..20: mol_type = other DNA
tcagaaaacattccttgaac

SEQ ID NO: 975 - DNA, 20 bp, synthetic construct
  source 1..20: mol_type = other DNA
gataatcacatttaaaaatg

SEQ ID NO: 976 - DNA, 20 bp, synthetic construct
  source 1..20: mol_type = other DNA
aaattagataatcacattta

SEQ ID NO: 977 - DNA, 20 bp, synthetic construct
  source 1..20: mol_type = other DNA
aaaattagataatcacattt

SEQ ID NO: 978 - DNA, 20 bp, synthetic construct
  source 1..20: mol_type = other DNA
aaaaattagataatcacatt

SEQ ID NO: 979 - DNA, 20 bp, synthetic construct
  source 1..20: mol_type = other DNA
taaaaattagataatcacat

SEQ ID NO: 980 - DNA, 20 bp, synthetic construct
  source 1..20: mol_type = other DNA
tgtaaaaattagataatcac

SEQ ID NO: 981 - DNA, 20 bp, synthetic construct
  source 1..20: mol_type = other DNA
tgttgtaaaaattagataat

SEQ ID NO: 982 - DNA, 20 bp, synthetic construct
  source 1..20: mol_type = other DNA
gtgttgtaaaaattagataa

SEQ ID NO: 983 - DNA, 20 bp, synthetic construct
  source 1..20: mol_type = other DNA
agtgttgtaaaaattagata

SEQ ID NO: 984 - DNA, 20 bp, synthetic construct
  source 1..20: mol_type = other DNA
cagtgttgtaaaaattagat

SEQ ID NO: 985 - DNA, 20 bp, synthetic construct
  source 1..20: mol_type = other DNA
taatagcccagtgttgtaaa

SEQ ID NO: 986 - DNA, 20 bp, synthetic construct
  source 1..20: mol_type = other DNA
cctaatagcccagtgttgta

SEQ ID NO: 987 - DNA, 20 bp, synthetic construct
  source 1..20: mol_type = other DNA
tcctaatagcccagtgttgt

SEQ ID NO: 988 - DNA, 20 bp, synthetic construct
  source 1..20: mol_type = other DNA
ttcctaatagcccagtgttg

SEQ ID NO: 989 - DNA, 20 bp, synthetic construct
  source 1..20: mol_type = other DNA
agttattcctaatagcccag

SEQ ID NO: 990 - DNA, 20 bp, synthetic construct
  source 1..20: mol_type = other DNA
aagttattcctaatagccca

SEQ ID NO: 991 - DNA, 20 bp, synthetic construct
  source 1..20: mol_type = other DNA
aaagttattcctaatagccc

SEQ ID NO: 992 - DNA, 20 bp, synthetic construct
  source 1..20: mol_type = other DNA
aaaagttattcctaatagcc

SEQ ID NO: 993 - DNA, 20 bp, synthetic construct
  source 1..20: mol_type = other DNA
aaaaagttattcctaatagc

SEQ ID NO: 994 - DNA, 20 bp, synthetic construct
  source 1..20: mol_type = other DNA
taaaaagttattcctaatag

SEQ ID NO: 995 - DNA, 20 bp, synthetic construct
  source 1..20: mol_type = other DNA
tttaaaaagttattcctaat

SEQ ID NO: 996 - DNA, 20 bp, synthetic construct
  source 1..20: mol_type = other DNA
cagaacagtaatttttaaaa

SEQ ID NO: 997 - DNA, 20 bp, synthetic construct
  source 1..20: mol_type = other DNA
tatacagaacagtaattttt

SEQ ID NO: 998 - DNA, 20 bp, synthetic construct
  source 1..20: mol_type = other DNA
ttatacagaacagtaatttt

SEQ ID NO: 999 - DNA, 20 bp, synthetic construct
  source 1..20: mol_type = other DNA
tttatacagaacagtaattt

SEQ ID NO: 1000 - DNA, 20 bp, synthetic construct
  source 1..20: mol_type = other DNA
atttatacagaacagtaatt

SEQ ID NO: 1001 - DNA, 20 bp, synthetic construct
  source 1..20: mol_type = other DNA
caaatatttatacagaacag

SEQ ID NO: 1002 - DNA, 20 bp, synthetic construct
  source 1..20: mol_type = other DNA
ttcaaatatttatacagaac

SEQ ID NO: 1003 - DNA, 20 bp, synthetic construct
  source 1..20: mol_type = other DNA
tttcaaatatttatacagaa

SEQ ID NO: 1004 - DNA, 20 bp, synthetic construct
  source 1..20: mol_type = other DNA
atttcaaatatttatacaga

SEQ ID NO: 1005 - DNA, 20 bp, synthetic construct
  source 1..20: mol_type = other DNA
gaatttcaaatatttataca

SEQ ID NO: 1006 - DNA, 20 bp, synthetic construct
  source 1..20: mol_type = other DNA
cttgaatttcaaatatttat

SEQ ID NO: 1007 - DNA, 20 bp, synthetic construct
  source 1..20: mol_type = other DNA
cagatattttctgtacttga

SEQ ID NO: 1008 - DNA, 20 bp, synthetic construct
  source 1..20: mol_type = other DNA
tttttgtttcagatattttc

SEQ ID NO: 1009 - DNA, 20 bp, synthetic construct
  source 1..20: mol_type = other DNA
ggccaaacaacaatgctttt

SEQ ID NO: 1010 - DNA, 20 bp, synthetic construct
  source 1..20: mol_type = other DNA
catggccaaacaacaatgct

SEQ ID NO: 1011 - DNA, 20 bp, synthetic construct
  source 1..20: mol_type = other DNA
tcatggccaaacaacaatgc

SEQ ID NO: 1012 - DNA, 20 bp, synthetic construct
  source 1..20: mol_type = other DNA
tatcatggccaaacaacaat

SEQ ID NO: 1013 - DNA, 20 bp, synthetic construct
  source 1..20: mol_type = other DNA
gcacttgtatcatggccaaa

SEQ ID NO: 1014 - DNA, 20 bp, synthetic construct
  source 1..20: mol_type = other DNA
tgcacttgtatcatggccaa

SEQ ID NO: 1015 - DNA, 20 bp, synthetic construct
  source 1..20: mol_type = other DNA
agcaaatgaacttaacgagg

SEQ ID NO: 1016 - DNA, 20 bp, synthetic construct
  source 1..20: mol_type = other DNA
aataacagcaaatgaactta

SEQ ID NO: 1017 - DNA, 20 bp, synthetic construct
  source 1..20: mol_type = other DNA
gtgtgtaataacagcaaatg

SEQ ID NO: 1018 - DNA, 20 bp, synthetic construct
  source 1..20: mol_type = other DNA
gtgtgtgtaataacagcaaa

SEQ ID NO: 1019 - DNA, 20 bp, synthetic construct
  source 1..20: mol_type = other DNA
tgtgtgtgtaataacagcaa

SEQ ID NO: 1020 - DNA, 20 bp, synthetic construct
  source 1..20: mol_type = other DNA
gcccggcttttctaacgacc

SEQ ID NO: 1021 - DNA, 20 bp, synthetic construct
  source 1..20: mol_type = other DNA
cacactaacaacagaatcct

SEQ ID NO: 1022 - DNA, 20 bp, synthetic construct
  source 1..20: mol_type = other DNA
tccacactaacaacagaatc

SEQ ID NO: 1023 - DNA, 20 bp, synthetic construct
  source 1..20: mol_type = other DNA
atccacactaacaacagaat

SEQ ID NO: 1024 - DNA, 20 bp, synthetic construct
  source 1..20: mol_type = other DNA
acatccacactaacaacaga

SEQ ID NO: 1025 - DNA, 20 bp, synthetic construct
  source 1..20: mol_type = other DNA
aacatccacactaacaacag

SEQ ID NO: 1026 - DNA, 20 bp, synthetic construct
  source 1..20: mol_type = other DNA
gaacatccacactaacaaca

SEQ ID NO: 1027 - DNA, 20 bp, synthetic construct
  source 1..20: mol_type = other DNA
ttgaacatccacactaacaa

SEQ ID NO: 1028 - DNA, 20 bp, synthetic construct
  source 1..20: mol_type = other DNA
tcattgaacatccacactaa

SEQ ID NO: 1029 - DNA, 20 bp, synthetic construct
  source 1..20: mol_type = other DNA
ctcattgaacatccacacta

SEQ ID NO: 1030 - DNA, 20 bp, synthetic construct
  source 1..20: mol_type = other DNA
actcattgaacatccacact

SEQ ID NO: 1031 - DNA, 20 bp, synthetic construct
  source 1..20: mol_type = other DNA
aactcattgaacatccacac

SEQ ID NO: 1032 - DNA, 20 bp, synthetic construct
  source 1..20: mol_type = other DNA
aaatacaactcattgaacat

SEQ ID NO: 1033 - DNA, 20 bp, synthetic construct
  source 1..20: mol_type = other DNA
aaaatacaactcattgaaca

SEQ ID NO: 1034 - DNA, 20 bp, synthetic construct
  source 1..20: mol_type = other DNA
taaaatacaactcattgaac

SEQ ID NO: 1035 - DNA, 20 bp, synthetic construct
  source 1..20: mol_type = other DNA
ttaaaatacaactcattgaa

SEQ ID NO: 1036 - DNA, 20 bp, synthetic construct
  source 1..20: mol_type = other DNA
atttaaaatacaactcattg

SEQ ID NO: 1037 - DNA, 20 bp, synthetic construct
  source 1..20: mol_type = other DNA
atatttaaaatacaactcat

SEQ ID NO: 1038 - DNA, 20 bp, synthetic construct
  source 1..20: mol_type = other DNA
gatatttaaaatacaactca

SEQ ID NO: 1039 - DNA, 20 bp, synthetic construct
  source 1..20: mol_type = other DNA
tgatatttaaaatacaactc

SEQ ID NO: 1040 - DNA, 20 bp, synthetic construct
  source 1..20: mol_type = other DNA
ttgatatttaaaatacaact

SEQ ID NO: 1041 - DNA, 20 bp, synthetic construct
  source 1..20: mol_type = other DNA
tttgatatttaaaatacaac

SEQ ID NO: 1042 - DNA, 20 bp, synthetic construct
  source 1..20: mol_type = other DNA
ttaataatctttgatattta

SEQ ID NO: 1043 - DNA, 20 bp, synthetic construct
  source 1..20: mol_type = other DNA
tctttatttaataatctttg

SEQ ID NO: 1044 - DNA, 20 bp, synthetic construct
  source 1..20: mol_type = other DNA
attatctttatttaataatc

SEQ ID NO: 1045 - DNA, 20 bp, synthetic construct
  source 1..20: mol_type = other DNA
aaacattatctttatttaat

SEQ ID NO: 1046 - DNA, 20 bp, synthetic construct
  source 1..20: mol_type = other DNA
gaaaagcaaacattatcttt

SEQ ID NO: 1047 - DNA, 20 bp, synthetic construct
  source 1..20: mol_type = other DNA
aaagtgagccttcttgtttc

SEQ ID NO: 1048 - DNA, 20 bp, synthetic construct
  source 1..20: mol_type = other DNA
acaaagtgagccttcttgtt

SEQ ID NO: 1049 - DNA, 20 bp, synthetic construct
  source 1..20: mol_type = other DNA
cacaaagtgagccttcttgt

SEQ ID NO: 1050 - DNA, 20 bp, synthetic construct
  source 1..20: mol_type = other DNA
gcacaaagtgagccttcttg

SEQ ID NO: 1051 - DNA, 20 bp, synthetic construct
  source 1..20: mol_type = other DNA
agcacaaagtgagccttctt

SEQ ID NO: 1052 - DNA, 20 bp, synthetic construct
  source 1..20: mol_type = other DNA
gagcacaaagtgagccttct

SEQ ID NO: 1053 - DNA, 20 bp, synthetic construct
  source 1..20: mol_type = other DNA
tgagcacaaagtgagccttc

SEQ ID NO: 1054 - DNA, 20 bp, synthetic construct
  source 1..20: mol_type = other DNA
ttgagcacaaagtgagcctt

SEQ ID NO: 1055 - DNA, 20 bp, synthetic construct
  source 1..20: mol_type = other DNA
tgttgagcacaaagtgagcc

SEQ ID NO: 1056 - DNA, 20 bp, synthetic construct
  source 1..20: mol_type = other DNA
taagttattcaggcaatgtt

SEQ ID NO: 1057 - DNA, 20 bp, synthetic construct
  source 1..20: mol_type = other DNA
aataagttattcaggcaatg

SEQ ID NO: 1058 - DNA, 20 bp, synthetic construct
  source 1..20: mol_type = other DNA
ctaaaatattctccttgcaa

SEQ ID NO: 1059 - DNA, 20 bp, synthetic construct
  source 1..20: mol_type = other DNA
gctaaaatattctccttgca

SEQ ID NO: 1060 - DNA, 20 bp, synthetic construct
  source 1..20: mol_type = other DNA
ggctaaaatattctccttgc

SEQ ID NO: 1061 - DNA, 20 bp, synthetic construct
  source 1..20: mol_type = other DNA
ggataattccacagggctaa

SEQ ID NO: 1062 - DNA, 20 bp, synthetic construct
  source 1..20: mol_type = other DNA
aggataattccacagggcta

SEQ ID NO: 1063 - DNA, 20 bp, synthetic construct
  source 1..20: mol_type = other DNA
gaggataattccacagggct

SEQ ID NO: 1064 - DNA, 20 bp, synthetic construct
  source 1..20: mol_type = other DNA
tgaggataattccacagggc

SEQ ID NO: 1065 - DNA, 20 bp, synthetic construct
  source 1..20: mol_type = other DNA
ttgaggataattccacaggg

SEQ ID NO: 1066 - DNA, 20 bp, synthetic construct
  source 1..20: mol_type = other DNA
attgaggataattccacagg

SEQ ID NO: 1067 - DNA, 20 bp, synthetic construct
  source 1..20: mol_type = other DNA
aattgaggataattccacag

SEQ ID NO: 1068 - DNA, 20 bp, synthetic construct
  source 1..20: mol_type = other DNA
tctcctcctcatccagctga

SEQ ID NO: 1069 - DNA, 20 bp, synthetic construct
  source 1..20: mol_type = other DNA
ctctcctcctcatccagctg

SEQ ID NO: 1070 - DNA, 20 bp, synthetic construct
  source 1..20: mol_type = other DNA
tcctctcctcctcatccagc

SEQ ID NO: 1071 - DNA, 20 bp, synthetic construct
  source 1..20: mol_type = other DNA
atcctctcctcctcatccag

SEQ ID NO: 1072 - DNA, 20 bp, synthetic construct
  source 1..20: mol_type = other DNA
tcatcctctcctcctcatcc

SEQ ID NO: 1073 - DNA, 20 bp, synthetic construct
  source 1..20: mol_type = other DNA
attctcatcctctcctcctc

SEQ ID NO: 1074 - DNA, 20 bp, synthetic construct
  source 1..20: mol_type = other DNA
cattctcatcctctcctcct

SEQ ID NO: 1075 - DNA, 20 bp, synthetic construct
  source 1..20: mol_type = other DNA
tgccattctcatcctctcct

SEQ ID NO: 1076 - DNA, 20 bp, synthetic construct
  source 1..20: mol_type = other DNA
ctgccattctcatcctctcc

SEQ ID NO: 1077 - DNA, 20 bp, synthetic construct
  source 1..20: mol_type = other DNA
gtaactcctccttctgccat

SEQ ID NO: 1078 - DNA, 20 bp, synthetic construct
  source 1..20: mol_type = other DNA
ctagtaactcctccttctgc

SEQ ID NO: 1079 - DNA, 20 bp, synthetic construct
  source 1..20: mol_type = other DNA
actagtaactcctccttctg

SEQ ID NO: 1080 - DNA, 20 bp, synthetic construct
  source 1..20: mol_type = other DNA
tcactagtaactcctccttc

SEQ ID NO: 1081 - DNA, 20 bp, synthetic construct
  source 1..20: mol_type = other DNA
ttcactagtaactcctcctt

SEQ ID NO: 1082 - DNA, 20 bp, synthetic construct
  source 1..20: mol_type = other DNA
tcttcactagtaactcctcc

SEQ ID NO: 1083 - DNA, 20 bp, synthetic construct
  source 1..20: mol_type = other DNA
gataatcttcactagtaact

SEQ ID NO: 1084 - DNA, 20 bp, synthetic construct
  source 1..20: mol_type = other DNA
gcgataatcttcactagtaa

SEQ ID NO: 1085 - DNA, 20 bp, synthetic construct
  source 1..20: mol_type = other DNA
tgcgataatcttcactagta

SEQ ID NO: 1086 - DNA, 20 bp, synthetic construct
  source 1..20: mol_type = other DNA
gtgcgataatcttcactagt

SEQ ID NO: 1087 - DNA, 20 bp, synthetic construct
  source 1..20: mol_type = other DNA
cgtgcgataatcttcactag

SEQ ID NO: 1088 - DNA, 20 bp, synthetic construct
  source 1..20: mol_type = other DNA
agaaggctgctgtaaaaacg

SEQ ID NO: 1089 - DNA, 20 bp, synthetic construct
  source 1..20: mol_type = other DNA
cagaaggctgctgtaaaaac

SEQ ID NO: 1090 - DNA, 20 bp, synthetic construct
  source 1..20: mol_type = other DNA
tccagaaggctgctgtaaaa

SEQ ID NO: 1091 - DNA, 20 bp, synthetic construct
  source 1..20: mol_type = other DNA
ccatatttccagaaggctgc

SEQ ID NO: 1092 - DNA, 20 bp, synthetic construct
  source 1..20: mol_type = other DNA
tccatatttccagaaggctg

SEQ ID NO: 1093 - DNA, 20 bp, synthetic construct
  source 1..20: mol_type = other DNA
atccatatttccagaaggct

SEQ ID NO: 1094 - DNA, 20 bp, synthetic construct
  source 1..20: mol_type = other DNA
catccatatttccagaaggc

SEQ ID NO: 1095 - DNA, 20 bp, synthetic construct
  source 1..20: mol_type = other DNA
tcatccatatttccagaagg

SEQ ID NO: 1096 - DNA, 20 bp, synthetic construct
  source 1..20: mol_type = other DNA
gtcatccatatttccagaag

SEQ ID NO: 1097 - DNA, 20 bp, synthetic construct
  source 1..20: mol_type = other DNA
actgtcatccatatttccag

SEQ ID NO: 1098 - DNA, 20 bp, synthetic construct
  source 1..20: mol_type = other DNA
cactgtcatccatatttcca

SEQ ID NO: 1099 - DNA, 20 bp, synthetic construct
  source 1..20: mol_type = other DNA
aaccactgtcatccatattt

SEQ ID NO: 1100 - DNA, 20 bp, synthetic construct
  source 1..20: mol_type = other DNA
gaaaaaaccactgtcatcca

SEQ ID NO: 1101 - DNA, 20 bp, synthetic construct
  source 1..20: mol_type = other DNA
agaaaaaaccactgtcatcc

SEQ ID NO: 1102 - DNA, 20 bp, synthetic construct
  source 1..20: mol_type = other DNA
agagaaaaaaccactgtcat

SEQ ID NO: 1103 - DNA, 20 bp, synthetic construct
  source 1..20: mol_type = other DNA
tagagaaaaaaccactgtca

SEQ ID NO: 1104 - DNA, 20 bp, synthetic construct
  source 1..20: mol_type = other DNA
aatagagaaaaaaccactgt

SEQ ID NO: 1105 - DNA, 20 bp, synthetic construct
  source 1..20: mol_type = other DNA
gaatagagaaaaaaccactg

SEQ ID NO: 1106 - DNA, 20 bp, synthetic construct
  source 1..20: mol_type = other DNA
tgaatagagaaaaaaccact

SEQ ID NO: 1107 - DNA, 20 bp, synthetic construct
  source 1..20: mol_type = other DNA
ctgaatagagaaaaaaccac

SEQ ID NO: 1108 - DNA, 20 bp, synthetic construct
  source 1..20: mol_type = other DNA
ttataacctgaatagagaaa

SEQ ID NO: 1109 - DNA, 20 bp, synthetic construct
  source 1..20: mol_type = other DNA
gcttataacctgaatagaga

SEQ ID NO: 1110 - DNA, 20 bp, synthetic construct
  source 1..20: mol_type = other DNA
tgcttataacctgaatagag

SEQ ID NO: 1111 - DNA, 20 bp, synthetic construct
  source 1..20: mol_type = other DNA
ttgcttataacctgaataga

SEQ ID NO: 1112 - DNA, 20 bp, synthetic construct
  source 1..20: mol_type = other DNA
attgcttataacctgaatag

SEQ ID NO: 1113 - DNA, 20 bp, synthetic construct
  source 1..20: mol_type = other DNA
gcattgcttataacctgaat

SEQ ID NO: 1114 - DNA, 20 bp, synthetic construct
  source 1..20: mol_type = other DNA
ggcattgcttataacctgaa

SEQ ID NO: 1115 - DNA, 20 bp, synthetic construct
  source 1..20: mol_type = other DNA
cacaaattcaaaaggaaata

SEQ ID NO: 1116 - DNA, 20 bp, synthetic construct
  source 1..20: mol_type = other DNA
acacaaattcaaaaggaaat

SEQ ID NO: 1117 - DNA, 20 bp, synthetic construct
  source 1..20: mol_type = other DNA
aaacacaaattcaaaaggaa

SEQ ID NO: 1118 - DNA, 20 bp, synthetic construct
  source 1..20: mol_type = other DNA
taaacacaaattcaaaagga

SEQ ID NO: 1119 - DNA, 20 bp, synthetic construct
  source 1..20: mol_type = other DNA
ttaacaataaacacaaattc

SEQ ID NO: 1120 - DNA, 20 bp, synthetic construct
  source 1..20: mol_type = other DNA
atgaattaacaataaacaca

SEQ ID NO: 1121 - DNA, 20 bp, synthetic construct
  source 1..20: mol_type = other DNA
tatgaattaacaataaacac

SEQ ID NO: 1122 - DNA, 20 bp, synthetic construct
  source 1..20: mol_type = other DNA
ctatgaattaacaataaaca

SEQ ID NO: 1123 - DNA, 20 bp, synthetic construct
  source 1..20: mol_type = other DNA
tagctatgaattaacaataa

SEQ ID NO: 1124 - DNA, 20 bp, synthetic construct
  source 1..20: mol_type = other DNA
aatagctatgaattaacaat

SEQ ID NO: 1125 - DNA, 20 bp, synthetic construct
  source 1..20: mol_type = other DNA
aatagaatatcaatggactg

SEQ ID NO: 1126 - DNA, 20 bp, synthetic construct
  source 1..20: mol_type = other DNA
tggaatagaatatcaatgga

SEQ ID NO: 1127 - DNA, 20 bp, synthetic construct
  source 1..20: mol_type = other DNA
gctggaatagaatatcaatg

SEQ ID NO: 1128 - DNA, 20 bp, synthetic construct
  source 1..20: mol_type = other DNA
tcaaataaaaatttggaatt

SEQ ID NO: 1129 - DNA, 20 bp, synthetic construct
  source 1..20: mol_type = other DNA
ttcaaataaaaatttggaat

SEQ ID NO: 1130 - DNA, 20 bp, synthetic construct
  source 1..20: mol_type = other DNA
tcctcaatcagtctaggtgg

SEQ ID NO: 1131 - DNA, 20 bp, synthetic construct
  source 1..20: mol_type = other DNA
ttcctcaatcagtctaggtg

SEQ ID NO: 1132 - DNA, 20 bp, synthetic construct
  source 1..20: mol_type = other DNA
aatatattcctcaatcagtc

SEQ ID NO: 1133 - DNA, 20 bp, synthetic construct
  source 1..20: mol_type = other DNA
caatatattcctcaatcagt

SEQ ID NO: 1134 - DNA, 20 bp, synthetic construct
  source 1..20: mol_type = other DNA
acaatatattcctcaatcag

SEQ ID NO: 1135 - DNA, 20 bp, synthetic construct
  source 1..20: mol_type = other DNA
gtgcccaatcctaattaaag

SEQ ID NO: 1136 - DNA, 20 bp, synthetic construct
  source 1..20: mol_type = other DNA
tgtgcccaatcctaattaaa

SEQ ID NO: 1137 - DNA, 20 bp, synthetic construct
  source 1..20: mol_type = other DNA
atgtttcaaaatttgtgccc

SEQ ID NO: 1138 - DNA, 20 bp, synthetic construct
  source 1..20: mol_type = other DNA
ttatgtttcaaaatttgtgc

SEQ ID NO: 1139 - DNA, 20 bp, synthetic construct
  source 1..20: mol_type = other DNA
attatgtttcaaaatttgtg

SEQ ID NO: 1140 - DNA, 20 bp, synthetic construct
  source 1..20: mol_type = other DNA
accctaatacaagagactct

SEQ ID NO: 1141 - DNA, 20 bp, synthetic construct
  source 1..20: mol_type = other DNA
tctaccctaatacaagagac

SEQ ID NO: 1142 - DNA, 20 bp, synthetic construct
  source 1..20: mol_type = other DNA
ccatgtagtgacatgtggct

SEQ ID NO: 1143 - DNA, 20 bp, synthetic construct
  source 1..20: mol_type = other DNA
ttttggaaaaaatggatctg

SEQ ID NO: 1144 - DNA, 20 bp, synthetic construct
  source 1..20: mol_type = other DNA
cttttggaaaaaatggatct

SEQ ID NO: 1145 - DNA, 20 bp, synthetic construct
  source 1..20: mol_type = other DNA
gcttttggaaaaaatggatc

SEQ ID NO: 1146 - DNA, 20 bp, synthetic construct
  source 1..20: mol_type = other DNA
gaattcaaacacagcttttg

SEQ ID NO: 1147 - DNA, 20 bp, synthetic construct
  source 1..20: mol_type = other DNA
tgcagaattcaaacacagct

SEQ ID NO: 1148 - DNA, 20 bp, synthetic construct
  source 1..20: mol_type = other DNA
ctgtgcagaattcaaacaca

SEQ ID NO: 1149 - DNA, 20 bp, synthetic construct
  source 1..20: mol_type = other DNA
gcccatactccctcccggct

SEQ ID NO: 1150 - DNA, 20 bp, synthetic construct
  source 1..20: mol_type = other DNA
cggccccgcccatactccct

SEQ ID NO: 1151 - DNA, 20 bp, synthetic construct
  source 1..20: mol_type = other DNA
agaagcaaacccactgggcg

SEQ ID NO: 1152 - DNA, 20 bp, synthetic construct
  source 1..20: mol_type = other DNA
gaaaagttaattctgccagg

SEQ ID NO: 1153 - DNA, 20 bp, synthetic construct
  source 1..20: mol_type = other DNA
acaagaccccaaagatctac

SEQ ID NO: 1154 - DNA, 20 bp, synthetic construct
  source 1..20: mol_type = other DNA
agtgggcgagccaaggtctc

SEQ ID NO: 1155 - DNA, 20 bp, synthetic construct
  source 1..20: mol_type = other DNA
gtaataaaaactcttgtgac

SEQ ID NO: 1156 - DNA, 20 bp, synthetic construct
  source 1..20: mol_type = other DNA
caaacccaaacatcccgtaa

SEQ ID NO: 1157 - DNA, 20 bp, synthetic construct
  source 1..20: mol_type = other DNA
aaaccaaacccaaacatccc

SEQ ID NO: 1158 - DNA, 20 bp, synthetic construct
  source 1..20: mol_type = other DNA
tgggagtaccaaaagaaacc

SEQ ID NO: 1159 - DNA, 20 bp, synthetic construct
  source 1..20: mol_type = other DNA
tacctaaaaacaaagctggc

SEQ ID NO: 1160 - DNA, 20 bp, synthetic construct
  source 1..20: mol_type = other DNA
atacctaaaaacaaagctgg

SEQ ID NO: 1161 - DNA, 20 bp, synthetic construct
  source 1..20: mol_type = other DNA
taatacctaaaaacaaagct

SEQ ID NO: 1162 - DNA, 20 bp, synthetic construct
  source 1..20: mol_type = other DNA
cctaatacctaaaaacaaag

SEQ ID NO: 1163 - DNA, 20 bp, synthetic construct
  source 1..20: mol_type = other DNA
tcctaatacctaaaaacaaa

SEQ ID NO: 1164 - DNA, 20 bp, synthetic construct
  source 1..20: mol_type = other DNA
ctcctaatacctaaaaacaa

SEQ ID NO: 1165 - DNA, 20 bp, synthetic construct
  source 1..20: mol_type = other DNA
actcctaatacctaaaaaca

SEQ ID NO: 1166 - DNA, 20 bp, synthetic construct
  source 1..20: mol_type = other DNA
cactcctaatacctaaaaac

SEQ ID NO: 1167 - DNA, 20 bp, synthetic construct
  source 1..20: mol_type = other DNA
ccactcctaatacctaaaaa

SEQ ID NO: 1168 - DNA, 20 bp, synthetic construct
  source 1..20: mol_type = other DNA
ccagtccactcctaatacct

SEQ ID NO: 1169 - DNA, 20 bp, synthetic construct
  source 1..20: mol_type = other DNA
acaacaaaatcatcccagtc

SEQ ID NO: 1170 - DNA, 20 bp, synthetic construct
  source 1..20: mol_type = other DNA
tacaacaaaatcatcccagt

SEQ ID NO: 1171 - DNA, 20 bp, synthetic construct
  source 1..20: mol_type = other DNA
aacagtatcttcaagtgcat

SEQ ID NO: 1172 - DNA, 20 bp, synthetic construct
  source 1..20: mol_type = other DNA
aaacagtatcttcaagtgca

SEQ ID NO: 1173 - DNA, 20 bp, synthetic construct
  source 1..20: mol_type = other DNA
gaggagtttctttacatatc

SEQ ID NO: 1174 - DNA, 20 bp, synthetic construct
  source 1..20: mol_type = other DNA
aacatgataccatgtgccaa

SEQ ID NO: 1175 - DNA, 20 bp, synthetic construct
  source 1..20: mol_type = other DNA
aacacgaaactattatgaaa

SEQ ID NO: 1176 - DNA, 20 bp, synthetic construct
  source 1..20: mol_type = other DNA
tcctcctattaaataacagc

SEQ ID NO: 1177 - DNA, 20 bp, synthetic construct
  source 1..20: mol_type = other DNA
ctttgctcctcctattaaat

SEQ ID NO: 1178 - DNA, 20 bp, synthetic construct
  source 1..20: mol_type = other DNA
taaatgatcatttataagta

SEQ ID NO: 1179 - DNA, 20 bp, synthetic construct
  source 1..20: mol_type = other DNA
tgtgaattttaaatgtctgg

SEQ ID NO: 1180 - DNA, 20 bp, synthetic construct
  source 1..20: mol_type = other DNA
gtgtgaattttaaatgtctg

SEQ ID NO: 1181 - DNA, 20 bp, synthetic construct
  source 1..20: mol_type = other DNA
tgtgtgaattttaaatgtct

SEQ ID NO: 1182 - DNA, 20 bp, synthetic construct
  source 1..20: mol_type = other DNA
gtgtgtgaattttaaatgtc

SEQ ID NO: 1183 - DNA, 20 bp, synthetic construct
  source 1..20: mol_type = other DNA
tctcccaaaaacattacctg

SEQ ID NO: 1184 - DNA, 20 bp, synthetic construct
  source 1..20: mol_type = other DNA
cgtctctcccaaaaacatta

SEQ ID NO: 1185 - DNA, 20 bp, synthetic construct
  source 1..20: mol_type = other DNA
gtacttaacaatttgttcca

SEQ ID NO: 1186 - DNA, 20 bp, synthetic construct
  source 1..20: mol_type = other DNA
tgtacttaacaatttgttcc

SEQ ID NO: 1187 - DNA, 20 bp, synthetic construct
  source 1..20: mol_type = other DNA
aagcattgtacttaacaatt

SEQ ID NO: 1188 - DNA, 20 bp, synthetic construct
  source 1..20: mol_type = other DNA
gagatgttttctacaatgaa

SEQ ID NO: 1189 - DNA, 20 bp, synthetic construct
  source 1..20: mol_type = other DNA
gcctatttcaaaagtttccg

SEQ ID NO: 1190 - DNA, 20 bp, synthetic construct
  source 1..20: mol_type = other DNA
agcctatttcaaaagtttcc

SEQ ID NO: 1191 - DNA, 20 bp, synthetic construct
  source 1..20: mol_type = other DNA
tagtgacaactatacgactg

SEQ ID NO: 1192 - DNA, 20 bp, synthetic construct
  source 1..20: mol_type = other DNA
ccaagcaaccaaatctctat

SEQ ID NO: 1193 - DNA, 20 bp, synthetic construct
  source 1..20: mol_type = other DNA
ataacaaaaatatggccggg

SEQ ID NO: 1194 - DNA, 20 bp, synthetic construct
  source 1..20: mol_type = other DNA
aataacaaaaatatggccgg

SEQ ID NO: 1195 - DNA, 20 bp, synthetic construct
  source 1..20: mol_type = other DNA
taataacaaaaatatggccg

SEQ ID NO: 1196 - DNA, 20 bp, synthetic construct
  source 1..20: mol_type = other DNA
ttaataacaaaaatatggcc

SEQ ID NO: 1197 - DNA, 20 bp, synthetic construct
  source 1..20: mol_type = other DNA
attaataacaaaaatatggc

SEQ ID NO: 1198 - DNA, 20 bp, synthetic construct
  source 1..20: mol_type = other DNA
aattaataacaaaaatatgg

SEQ ID NO: 1199 - DNA, 20 bp, synthetic construct
  source 1..20: mol_type = other DNA
ctttgaaaattaataacaaa

SEQ ID NO: 1200 - DNA, 20 bp, synthetic construct
  source 1..20: mol_type = other DNA
gcctttgaaaattaataaca

SEQ ID NO: 1201 - DNA, 20 bp, synthetic construct
  source 1..20: mol_type = other DNA
gtcccacaccaaagcctttg

SEQ ID NO: 1202 - DNA, 20 bp, synthetic construct
  source 1..20: mol_type = other DNA
atattgttaaaaatcttgtc

SEQ ID NO: 1203 - DNA, 20 bp, synthetic construct
  source 1..20: mol_type = other DNA
caatattgttaaaaatcttg

SEQ ID NO: 1204 - DNA, 20 bp, synthetic construct
  source 1..20: mol_type = other DNA
aaaaactaaattgttgaatc

SEQ ID NO: 1205 - DNA, 20 bp, synthetic construct
  source 1..20: mol_type = other DNA
ccaaaaaactaaattgttga

SEQ ID NO: 1206 - DNA, 20 bp, synthetic construct
  source 1..20: mol_type = other DNA
gcccaaaaaactaaattgtt

SEQ ID NO: 1207 - DNA, 20 bp, synthetic construct
  source 1..20: mol_type = other DNA
cgcccaaaaaactaaattgt

SEQ ID NO: 1208 - DNA, 20 bp, synthetic construct
  source 1..20: mol_type = other DNA
cacagtaagcccaaacattc

SEQ ID NO: 1209 - DNA, 20 bp, synthetic construct
  source 1..20: mol_type = other DNA
agcaagggttaaaggtatat

SEQ ID NO: 1210 - DNA, 20 bp, synthetic construct
  source 1..20: mol_type = other DNA
ctctccaaacccaggaccta

SEQ ID NO: 1211 - DNA, 20 bp, synthetic construct
  source 1..20: mol_type = other DNA
ctttagggccaaagttggtt

SEQ ID NO: 1212 - DNA, 20 bp, synthetic construct
  source 1..20: mol_type = other DNA
acacagcttctttagggcca

SEQ ID NO: 1213 - DNA, 20 bp, synthetic construct
  source 1..20: mol_type = other DNA
ccaaggttccaagaggaaat

SEQ ID NO: 1214 - DNA, 20 bp, synthetic construct
  source 1..20: mol_type = other DNA
aagaggaaaccaaggttcca

SEQ ID NO: 1215 - DNA, 20 bp, synthetic construct
  source 1..20: mol_type = other DNA
aagggtactcaaagtgacta

SEQ ID NO: 1216 - DNA, 20 bp, synthetic construct
  source 1..20: mol_type = other DNA
tacattctaacttaataaag

SEQ ID NO: 1217 - DNA, 20 bp, synthetic construct
  source 1..20: mol_type = other DNA
gtttttacattctaacttaa

SEQ ID NO: 1218 - DNA, 20 bp, synthetic construct
  source 1..20: mol_type = other DNA
aaactgtttttacattctaa

SEQ ID NO: 1219 - DNA, 20 bp, synthetic construct
  source 1..20: mol_type = other DNA
gaaactgtttttacattcta

SEQ ID NO: 1220 - DNA, 20 bp, synthetic construct
  source 1..20: mol_type = other DNA
gccccattcaaatatttatt

SEQ ID NO: 1221 - DNA, 20 bp, synthetic construct
  source 1..20: mol_type = other DNA
tccattcaaatatatacatt

SEQ ID NO: 1222 - DNA, 20 bp, synthetic construct
  source 1..20: mol_type = other DNA
ttatccattcaaatatatac

SEQ ID NO: 1223 - DNA, 20 bp, synthetic construct
  source 1..20: mol_type = other DNA
ctctttatccattcaaatat

SEQ ID NO: 1224 - DNA, 20 bp, synthetic construct
  source 1..20: mol_type = other DNA
tctctttatccattcaaata

SEQ ID NO: 1225 - DNA, 20 bp, synthetic construct
  source 1..20: mol_type = other DNA
catatatatctcagaaactc

SEQ ID NO: 1226 - DNA, 20 bp, synthetic construct
  source 1..20: mol_type = other DNA
gcaccatatatatctcagaa

SEQ ID NO: 1227 - DNA, 20 bp, synthetic construct
  source 1..20: mol_type = other DNA
agcaccatatatatctcaga

SEQ ID NO: 1228 - DNA, 20 bp, synthetic construct
  source 1..20: mol_type = other DNA
cagcaccatatatatctcag

SEQ ID NO: 1229 - DNA, 20 bp, synthetic construct
  source 1..20: mol_type = other DNA
aacagcaccatatatatctc

SEQ ID NO: 1230 - DNA, 20 bp, synthetic construct
  source 1..20: mol_type = other DNA
ctttagataaacagcaccat

SEQ ID NO: 1231 - DNA, 20 bp, synthetic construct
  source 1..20: mol_type = other DNA
tttactttagataaacagca

SEQ ID NO: 1232 - DNA, 20 bp, synthetic construct
  source 1..20: mol_type = other DNA
ccttaaaatatttacagaaa

SEQ ID NO: 1233 - DNA, 20 bp, synthetic construct
  source 1..20: mol_type = other DNA
cctgcaaagccttaaaatat

SEQ ID NO: 1234 - DNA, 20 bp, synthetic construct
  source 1..20: mol_type = other DNA
tgacagagactacagctggc

SEQ ID NO: 1235 - DNA, 20 bp, synthetic construct
  source 1..20: mol_type = other DNA
gttgggaaaaacatgcacaa

SEQ ID NO: 1236 - DNA, 20 bp, synthetic construct
  source 1..20: mol_type = other DNA
tggttgggaaaaacatgcac

SEQ ID NO: 1237 - DNA, 20 bp, synthetic construct
  source 1..20: mol_type = other DNA
actttacatttttacatggt

SEQ ID NO: 1238 - DNA, 20 bp, synthetic construct
  source 1..20: mol_type = other DNA
agtagctaagaatgcacttt

SEQ ID NO: 1239 - DNA, 20 bp, synthetic construct
  source 1..20: mol_type = other DNA
atgggccaaattcaacctgc

SEQ ID NO: 1240 - DNA, 20 bp, synthetic construct
  source 1..20: mol_type = other DNA
caacaaaaatccagtagtgg

SEQ ID NO: 1241 - DNA, 20 bp, synthetic construct
  source 1..20: mol_type = other DNA
acaacaaaaatccagtagtg

SEQ ID NO: 1242 - DNA, 20 bp, synthetic construct
  source 1..20: mol_type = other DNA
cagaactaaaacaaacaaca

SEQ ID NO: 1243 - DNA, 20 bp, synthetic construct
  source 1..20: mol_type = other DNA
accagaactaaaacaaacaa

SEQ ID NO: 1244 - DNA, 20 bp, synthetic construct
  source 1..20: mol_type = other DNA
caccagaactaaaacaaaca

SEQ ID NO: 1245 - DNA, 20 bp, synthetic construct
  source 1..20: mol_type = other DNA
ggcaccagaactaaaacaaa

SEQ ID NO: 1246 - DNA, 20 bp, synthetic construct
  source 1..20: mol_type = other DNA
agcaggcaccagaactaaaa

SEQ ID NO: 1247 - DNA, 20 bp, synthetic construct
  source 1..20: mol_type = other DNA
taactgcaccaagaaacatc

SEQ ID NO: 1248 - DNA, 20 bp, synthetic construct
  source 1..20: mol_type = other DNA
gcaccaatacaaatggcaca

SEQ ID NO: 1249 - DNA, 20 bp, synthetic construct
  source 1..20: mol_type = other DNA
aagcaccaatacaaatggca

SEQ ID NO: 1250 - DNA, 20 bp, synthetic construct
  source 1..20: mol_type = other DNA
tttgcattacattaaaagca

SEQ ID NO: 1251 - DNA, 20 bp, synthetic construct
  source 1..20: mol_type = other DNA
gatattattaccagtttgca

SEQ ID NO: 1252 - DNA, 20 bp, synthetic construct
  source 1..20: mol_type = other DNA
atgtacaaccccagcaagtt

SEQ ID NO: 1253 - DNA, 20 bp, synthetic construct
  source 1..20: mol_type = other DNA
tatgtacaaccccagcaagt

SEQ ID NO: 1254 - DNA, 20 bp, synthetic construct
  source 1..20: mol_type = other DNA
ttcaataattttatgtacaa

SEQ ID NO: 1255 - DNA, 20 bp, synthetic construct
  source 1..20: mol_type = other DNA
gggcataatgaatgccacag

SEQ ID NO: 1256 - DNA, 20 bp, synthetic construct
  source 1..20: mol_type = other DNA
tggctaaaatccagcaatca

SEQ ID NO: 1257 - DNA, 20 bp, synthetic construct
  source 1..20: mol_type = other DNA
ggcttctcctaaagctcaaa

SEQ ID NO: 1258 - DNA, 20 bp, synthetic construct
  source 1..20: mol_type = other DNA
tcatttatacagaatttggc

SEQ ID NO: 1259 - DNA, 20 bp, synthetic construct
  source 1..20: mol_type = other DNA
gcacttcaagtcatttatac

SEQ ID NO: 1260 - DNA, 20 bp, synthetic construct
  source 1..20: mol_type = other DNA
actatctgccagggagcctt

SEQ ID NO: 1261 - DNA, 20 bp, synthetic construct
  source 1..20: mol_type = other DNA
ggcaatggccagtacttcta

SEQ ID NO: 1262 - DNA, 20 bp, synthetic construct
  source 1..20: mol_type = other DNA
tctccgagcccttactatga

SEQ ID NO: 1263 - DNA, 20 bp, synthetic construct
  source 1..20: mol_type = other DNA
aggtataaacctaaggtgct

SEQ ID NO: 1264 - DNA, 20 bp, synthetic construct
  source 1..20: mol_type = other DNA
acaacacaaatcaggtataa

SEQ ID NO: 1265 - DNA, 20 bp, synthetic construct
  source 1..20: mol_type = other DNA
actacaacacaaatcaggta

SEQ ID NO: 1266 - DNA, 20 bp, synthetic construct
  source 1..20: mol_type = other DNA
taactacaacacaaatcagg

SEQ ID NO: 1267 - DNA, 20 bp, synthetic construct
  source 1..20: mol_type = other DNA
cactactaactacaacacaa

SEQ ID NO: 1268 - DNA, 20 bp, synthetic construct
  source 1..20: mol_type = other DNA
acactactaactacaacaca

SEQ ID NO: 1269 - DNA, 20 bp, synthetic construct
  source 1..20: mol_type = other DNA
cagagacactactaactaca

SEQ ID NO: 1270 - DNA, 20 bp, synthetic construct
  source 1..20: mol_type = other DNA
gttcaaattaccagagacac

SEQ ID NO: 1271 - DNA, 20 bp, synthetic construct
  source 1..20: mol_type = other DNA
tagttcaaattaccagagac

SEQ ID NO: 1272 - DNA, 20 bp, synthetic construct
  source 1..20: mol_type = other DNA
ctagttcaaattaccagaga

SEQ ID NO: 1273 - DNA, 20 bp, synthetic construct
  source 1..20: mol_type = other DNA
aaactagttcaaattaccag

SEQ ID NO: 1274 - DNA, 20 bp, synthetic construct
  source 1..20: mol_type = other DNA
caagaccaacctgaaactag

SEQ ID NO: 1275 - DNA, 20 bp, synthetic construct
  source 1..20: mol_type = other DNA
gttttcaagaccaacctgaa

SEQ ID NO: 1276 - DNA, 20 bp, synthetic construct
  source 1..20: mol_type = other DNA
tcatttacccccaacctccc

SEQ ID NO: 1277 - DNA, 20 bp, synthetic construct
  source 1..20: mol_type = other DNA
aaatcatttacccccaacct

SEQ ID NO: 1278 - DNA, 20 bp, synthetic construct
  source 1..20: mol_type = other DNA
taccaaatcatttaccccca

SEQ ID NO: 1279 - DNA, 20 bp, synthetic construct
  source 1..20: mol_type = other DNA
gctaccaaatcatttacccc

SEQ ID NO: 1280 - DNA, 20 bp, synthetic construct
  source 1..20: mol_type = other DNA
tgctaccaaatcatttaccc

SEQ ID NO: 1281 - DNA, 20 bp, synthetic construct
  source 1..20: mol_type = other DNA
aactgctaccaaatcattta

SEQ ID NO: 1282 - DNA, 20 bp, synthetic construct
  source 1..20: mol_type = other DNA
gcagttctacaaagataatg

SEQ ID NO: 1283 - DNA, 20 bp, synthetic construct
  source 1..20: mol_type = other DNA
attgaaatctcatgatttgg

SEQ ID NO: 1284 - DNA, 20 bp, synthetic construct
  source 1..20: mol_type = other DNA
tattgaaatctcatgatttg

SEQ ID NO: 1285 - DNA, 20 bp, synthetic construct
  source 1..20: mol_type = other DNA
tgccataatcaaagttcagc

SEQ ID NO: 1286 - DNA, 20 bp, synthetic construct
  source 1..20: mol_type = other DNA
tttgccataatcaaagttca

SEQ ID NO: 1287 - DNA, 20 bp, synthetic construct
  source 1..20: mol_type = other DNA
tcactttgccataatcaaag

SEQ ID NO: 1288 - DNA, 20 bp, synthetic construct
  source 1..20: mol_type = other DNA
gttcactttgccataatcaa

SEQ ID NO: 1289 - DNA, 20 bp, synthetic construct
  source 1..20: mol_type = other DNA
agctttaatcaaagcagaag

SEQ ID NO: 1290 - DNA, 20 bp, synthetic construct
  source 1..20: mol_type = other DNA
tcaagctttaatcaaagcag

SEQ ID NO: 1291 - DNA, 20 bp, synthetic construct
  source 1..20: mol_type = other DNA
tcaaactatccccagccacc

SEQ ID NO: 1292 - DNA, 20 bp, synthetic construct
  source 1..20: mol_type = other DNA
tatctcaaactatccccagc

SEQ ID NO: 1293 - DNA, 20 bp, synthetic construct
  source 1..20: mol_type = other DNA
cttatctcaaactatcccca

SEQ ID NO: 1294 - DNA, 20 bp, synthetic construct
  source 1..20: mol_type = other DNA
tgcccttatctcaaactatc

SEQ ID NO: 1295 - DNA, 20 bp, synthetic construct
  source 1..20: mol_type = other DNA
ctgccttgcccttatctcaa

SEQ ID NO: 1296 - DNA, 20 bp, synthetic construct
  source 1..20: mol_type = other DNA
tatgcattttcctgccttgc

SEQ ID NO: 1297 - DNA, 20 bp, synthetic construct
  source 1..20: mol_type = other DNA
accaaaagaattgtacaatg

SEQ ID NO: 1298 - DNA, 20 bp, synthetic construct
  source 1..20: mol_type = other DNA
ggaccaaaagaattgtacaa

SEQ ID NO: 1299 - DNA, 20 bp, synthetic construct
  source 1..20: mol_type = other DNA
cacatggaccaaaagaattg

SEQ ID NO: 1300 - DNA, 20 bp, synthetic construct
  source 1..20: mol_type = other DNA
acggatcaaattccacatgg

SEQ ID NO: 1301 - DNA, 20 bp, synthetic construct
  source 1..20: mol_type = other DNA
tggttcatactataatctca

SEQ ID NO: 1302 - DNA, 20 bp, synthetic construct
  source 1..20: mol_type = other DNA
tcagtacaaatttaaaaatc

SEQ ID NO: 1303 - DNA, 20 bp, synthetic construct
  source 1..20: mol_type = other DNA
tgttcagtacaaatttaaaa

SEQ ID NO: 1304 - DNA, 20 bp, synthetic construct
  source 1..20: mol_type = other DNA
caaactgttcagtacaaatt

SEQ ID NO: 1305 - DNA, 20 bp, synthetic construct
  source 1..20: mol_type = other DNA
aaaggacaaactgttcagta

SEQ ID NO: 1306 - DNA, 20 bp, synthetic construct
  source 1..20: mol_type = other DNA
ttctaatatgatttaatgga

SEQ ID NO: 1307 - DNA, 20 bp, synthetic construct
  source 1..20: mol_type = other DNA
cttctaatatgatttaatgg

SEQ ID NO: 1308 - DNA, 20 bp, synthetic construct
  source 1..20: mol_type = other DNA
caggaaatatcaagttctgt

SEQ ID NO: 1309 - DNA, 20 bp, synthetic construct
  source 1..20: mol_type = other DNA
acaggaaatatcaagttctg

SEQ ID NO: 1310 - DNA, 20 bp, synthetic construct
  source 1..20: mol_type = other DNA
caaagaaaaactgtattgct

SEQ ID NO: 1311 - DNA, 20 bp, synthetic construct
  source 1..20: mol_type = other DNA
aaatcaaacttcatcaaaga

SEQ ID NO: 1312 - DNA, 20 bp, synthetic construct
  source 1..20: mol_type = other DNA
gaaatcaaacttcatcaaag

SEQ ID NO: 1313 - DNA, 20 bp, synthetic construct
  source 1..20: mol_type = other DNA
tgaaatcaaacttcatcaaa

SEQ ID NO: 1314 - DNA, 20 bp, synthetic construct
  source 1..20: mol_type = other DNA
acttgaaatcaaacttcatc

SEQ ID NO: 1315 - DNA, 20 bp, synthetic construct
  source 1..20: mol_type = other DNA
tagctttaaattatgaaaaa

SEQ ID NO: 1316 - DNA, 20 bp, synthetic construct
  source 1..20: mol_type = other DNA
atagctttaaattatgaaaa

SEQ ID NO: 1317 - DNA, 20 bp, synthetic construct
  source 1..20: mol_type = other DNA
aaatagctttaaattatgaa

SEQ ID NO: 1318 - DNA, 20 bp, synthetic construct
  source 1..20: mol_type = other DNA
ctctataaaaaatagcttta

SEQ ID NO: 1319 - DNA, 20 bp, synthetic construct
  source 1..20: mol_type = other DNA
ttgattaaaattctctctat

SEQ ID NO: 1320 - DNA, 20 bp, synthetic construct
  source 1..20: mol_type = other DNA
gacatccaaatatttgatta

SEQ ID NO: 1321 - DNA, 20 bp, synthetic construct
  source 1..20: mol_type = other DNA
agtgacatccaaatatttga

SEQ ID NO: 1322 - DNA, 20 bp, synthetic construct
  source 1..20: mol_type = other DNA
cttaataccatatatagcaa

SEQ ID NO: 1323 - DNA, 20 bp, synthetic construct
  source 1..20: mol_type = other DNA
tacttaataccatatatagc

SEQ ID NO: 1324 - DNA, 20 bp, synthetic construct
  source 1..20: mol_type = other DNA
atacttaataccatatatag

SEQ ID NO: 1325 - DNA, 20 bp, synthetic construct
  source 1..20: mol_type = other DNA
tatggtcaccatacttaata

SEQ ID NO: 1326 - DNA, 20 bp, synthetic construct
  source 1..20: mol_type = other DNA
gtttacaaactatggtcacc

SEQ ID NO: 1327 - DNA, 20 bp, synthetic construct
  source 1..20: mol_type = other DNA
gagtttacaaactatggtca

SEQ ID NO: 1328 - DNA, 20 bp, synthetic construct
  source 1..20: mol_type = other DNA
cacaaatttcctgtcttgct

SEQ ID NO: 1329 - DNA, 20 bp, synthetic construct
  source 1..20: mol_type = other DNA
ctaacacaaatttcctgtct

SEQ ID NO: 1330 - DNA, 20 bp, synthetic construct
  source 1..20: mol_type = other DNA
ttgctaacacaaatttcctg

SEQ ID NO: 1331 - DNA, 20 bp, synthetic construct
  source 1..20: mol_type = other DNA
ctttgctaacacaaatttcc

SEQ ID NO: 1332 - DNA, 20 bp, synthetic construct
  source 1..20: mol_type = other DNA
agaaaaaagcctttgctaac

SEQ ID NO: 1333 - DNA, 20 bp, synthetic construct
  source 1..20: mol_type = other DNA
taaaaaattcaaacagtaag

SEQ ID NO: 1334 - DNA, 20 bp, synthetic construct
  source 1..20: mol_type = other DNA
tcaggcaaaactcatttatg

SEQ ID NO: 1335 - DNA, 20 bp, synthetic construct
  source 1..20: mol_type = other DNA
tccagtcacaaaagctcaaa

SEQ ID NO: 1336 - DNA, 20 bp, synthetic construct
  source 1..20: mol_type = other DNA
ttccagtcacaaaagctcaa

SEQ ID NO: 1337 - DNA, 20 bp, synthetic construct
  source 1..20: mol_type = other DNA
atggtaaactaaagaggaca

SEQ ID NO: 1338 - DNA, 20 bp, synthetic construct
  source 1..20: mol_type = other DNA
acaatggtaaactaaagagg

SEQ ID NO: 1339 - DNA, 20 bp, synthetic construct
  source 1..20: mol_type = other DNA
tttctcaaacaatggtaaac

SEQ ID NO: 1340 - DNA, 20 bp, synthetic construct
  source 1..20: mol_type = other DNA
gataaatttctcaaacaatg

SEQ ID NO: 1341 - DNA, 20 bp, synthetic construct
  source 1..20: mol_type = other DNA
aattaacaataattaacagt

SEQ ID NO: 1342 - DNA, 20 bp, synthetic construct
  source 1..20: mol_type = other DNA
gttaattaacaataattaac

SEQ ID NO: 1343 - DNA, 20 bp, synthetic construct
  source 1..20: mol_type = other DNA
atgaattaactacaacagta

SEQ ID NO: 1344 - DNA, 20 bp, synthetic construct
  source 1..20: mol_type = other DNA
ctcacaaaagaatactagat

SEQ ID NO: 1345 - DNA, 20 bp, synthetic construct
  source 1..20: mol_type = other DNA
gtgtttactcacaaaagaat

SEQ ID NO: 1346 - DNA, 20 bp, synthetic construct
  source 1..20: mol_type = other DNA
gaaacgacccaaatggatag

SEQ ID NO: 1347 - DNA, 20 bp, synthetic construct
  source 1..20: mol_type = other DNA
tggaaacgacccaaatggat

SEQ ID NO: 1348 - DNA, 20 bp, synthetic construct
  source 1..20: mol_type = other DNA
atagcattactatttgtaat

SEQ ID NO: 1349 - DNA, 20 bp, synthetic construct
  source 1..20: mol_type = other DNA
atagcattacagatagcatt

SEQ ID NO: 1350 - DNA, 20 bp, synthetic construct
  source 1..20: mol_type = other DNA
gtagtaatacaaaatagcat

SEQ ID NO: 1351 - DNA, 20 bp, synthetic construct
  source 1..20: mol_type = other DNA
atagcattactatttgtagt

SEQ ID NO: 1352 - DNA, 20 bp, synthetic construct
  source 1..20: mol_type = other DNA
atctcctatgatctagcaat

SEQ ID NO: 1353 - DNA, 20 bp, synthetic construct
  source 1..20: mol_type = other DNA
aagcttaatatatacatctc

SEQ ID NO: 1354 - DNA, 20 bp, synthetic construct
  source 1..20: mol_type = other DNA
taaagcttaatatatacatc

SEQ ID NO: 1355 - DNA, 20 bp, synthetic construct
  source 1..20: mol_type = other DNA
actaataattatgtaatgca

SEQ ID NO: 1356 - DNA, 20 bp, synthetic construct
  source 1..20: mol_type = other DNA
taactaataattatgtaatg

SEQ ID NO: 1357 - DNA, 20 bp, synthetic construct
  source 1..20: mol_type = other DNA
ataactaataattatgtaat

SEQ ID NO: 1358 - DNA, 20 bp, synthetic construct
  source 1..20: mol_type = other DNA
aataactaataattatgtaa

SEQ ID NO: 1359 - DNA, 20 bp, synthetic construct
  source 1..20: mol_type = other DNA
ccaataataactaataatta

SEQ ID NO: 1360 - DNA, 20 bp, synthetic construct
  source 1..20: mol_type = other DNA
accaataataactaataatt

SEQ ID NO: 1361 - DNA, 20 bp, synthetic construct
  source 1..20: mol_type = other DNA
ttggtataaccaataataac

SEQ ID NO: 1362 - DNA, 20 bp, synthetic construct
  source 1..20: mol_type = other DNA
cacaaactctaaaatggcta

SEQ ID NO: 1363 - DNA, 20 bp, synthetic construct
  source 1..20: mol_type = other DNA
ggcaagacaaacaagcactt

SEQ ID NO: 1364 - DNA, 20 bp, synthetic construct
  source 1..20: mol_type = other DNA
cttgagccccaaaaaggtcg

SEQ ID NO: 1365 - DNA, 20 bp, synthetic construct
  source 1..20: mol_type = other DNA
tgaaaaatagccaaggctgg

SEQ ID NO: 1366 - DNA, 20 bp, synthetic construct
  source 1..20: mol_type = other DNA
ctacttatatccttttgaaa

SEQ ID NO: 1367 - DNA, 20 bp, synthetic construct
  source 1..20: mol_type = other DNA
ggatatacagatgttctact

SEQ ID NO: 1368 - DNA, 20 bp, synthetic construct
  source 1..20: mol_type = other DNA
agggatatacagatgttcta

SEQ ID NO: 1369 - DNA, 20 bp, synthetic construct
  source 1..20: mol_type = other DNA
gaagggatatacagatgttc

SEQ ID NO: 1370 - DNA, 20 bp, synthetic construct
  source 1..20: mol_type = other DNA
tactgaataatatgcaaatt

SEQ ID NO: 1371 - DNA, 20 bp, synthetic construct
  source 1..20: mol_type = other DNA
actcttactgaataatatgc

SEQ ID NO: 1372 - DNA, 20 bp, synthetic construct
  source 1..20: mol_type = other DNA
tatttctactaccagagtgc

SEQ ID NO: 1373 - DNA, 20 bp, synthetic construct
  source 1..20: mol_type = other DNA
ctttctcctccttatatatt

SEQ ID NO: 1374 - DNA, 20 bp, synthetic construct
  source 1..20: mol_type = other DNA
aagtttatcttcaacttttc

SEQ ID NO: 1375 - DNA, 20 bp, synthetic construct
  source 1..20: mol_type = other DNA
taagtttatcttcaactttt

SEQ ID NO: 1376 - DNA, 20 bp, synthetic construct
  source 1..20: mol_type = other DNA
gtgaaaaaaatatgggttat

SEQ ID NO: 1377 - DNA, 20 bp, synthetic construct
  source 1..20: mol_type = other DNA
ggtgaaaaaaatatgggtta

SEQ ID NO: 1378 - DNA, 20 bp, synthetic construct
  source 1..20: mol_type = other DNA
tggtgaaaaaaatatgggtt

SEQ ID NO: 1379 - DNA, 20 bp, synthetic construct
  source 1..20: mol_type = other DNA
ctggtgaaaaaaatatgggt

SEQ ID NO: 1380 - DNA, 20 bp, synthetic construct
  source 1..20: mol_type = other DNA
agctggtgaaaaaaatatgg

SEQ ID NO: 1381 - DNA, 20 bp, synthetic construct
  source 1..20: mol_type = other DNA
tcagctggtgaaaaaaatat

SEQ ID NO: 1382 - DNA, 20 bp, synthetic construct
  source 1..20: mol_type = other DNA
aggagcaaaattcagctggt

SEQ ID NO: 1383 - DNA, 20 bp, synthetic construct
  source 1..20: mol_type = other DNA
aaagagaaccaccttgcaag

SEQ ID NO: 1384 - DNA, 20 bp, synthetic construct
  source 1..20: mol_type = other DNA
ctaaagagaaccaccttgca

SEQ ID NO: 1385 - DNA, 20 bp, synthetic construct
  source 1..20: mol_type = other DNA
ttccttaacccaacctatct

SEQ ID NO: 1386 - DNA, 20 bp, synthetic construct
  source 1..20: mol_type = other DNA
attccttaacccaacctatc

SEQ ID NO: 1387 - DNA, 20 bp, synthetic construct
  source 1..20: mol_type = other DNA
ggtctattccttaacccaac

SEQ ID NO: 1388 - DNA, 20 bp, synthetic construct
  source 1..20: mol_type = other DNA
aggtctattccttaacccaa

SEQ ID NO: 1389 - DNA, 20 bp, synthetic construct
  source 1..20: mol_type = other DNA
aaggtctattccttaaccca

SEQ ID NO: 1390 - DNA, 20 bp, synthetic construct
  source 1..20: mol_type = other DNA
tctctctttccccaataagg

SEQ ID NO: 1391 - DNA, 20 bp, synthetic construct
  source 1..20: mol_type = other DNA
agaacatttccttctcctgc

SEQ ID NO: 1392 - DNA, 20 bp, synthetic construct
  source 1..20: mol_type = other DNA
tgaatccaagtccagggtgc

SEQ ID NO: 1393 - DNA, 20 bp, synthetic construct
  source 1..20: mol_type = other DNA
gggcagtttctcacacaact

SEQ ID NO: 1394 - DNA, 20 bp, synthetic construct
  source 1..20: mol_type = other DNA
cctggacaagccagcaagag

SEQ ID NO: 1395 - DNA, 20 bp, synthetic construct
  source 1..20: mol_type = other DNA
gaactgtcccaaacaaccct

SEQ ID NO: 1396 - DNA, 20 bp, synthetic construct
  source 1..20: mol_type = other DNA
ggaactctacagataatgta

SEQ ID NO: 1397 - DNA, 20 bp, synthetic construct
  source 1..20: mol_type = other DNA
gttccatgttaaaacttgca

SEQ ID NO: 1398 - DNA, 20 bp, synthetic construct
  source 1..20: mol_type = other DNA
attctgttccatgttaaaac

SEQ ID NO: 1399 - DNA, 20 bp, synthetic construct
  source 1..20: mol_type = other DNA
gtgagaaaaattctgttcca

SEQ ID NO: 1400 - DNA, 20 bp, synthetic construct
  source 1..20: mol_type = other DNA
caggtgagaaaaattctgtt

SEQ ID NO: 1401 - DNA, 20 bp, synthetic construct
  source 1..20: mol_type = other DNA
cacacaatctaaatgcttgt

SEQ ID NO: 1402 - DNA, 20 bp, synthetic construct
  source 1..20: mol_type = other DNA
catttattcttttaacatga

SEQ ID NO: 1403 - DNA, 20 bp, synthetic construct
  source 1..20: mol_type = other DNA
agaacatttattcttttaac

SEQ ID NO: 1404 - DNA, 20 bp, synthetic construct
  source 1..20: mol_type = other DNA
ccctagaacatttattcttt

SEQ ID NO: 1405 - DNA, 20 bp, synthetic construct
  source 1..20: mol_type = other DNA
gaaaggaaattttagtccct

SEQ ID NO: 1406 - DNA, 20 bp, synthetic construct
  source 1..20: mol_type = other DNA
actaatggtgaaaggaaatt

SEQ ID NO: 1407 - DNA, 20 bp, synthetic construct
  source 1..20: mol_type = other DNA
agtaaattactaatggtgaa

SEQ ID NO: 1408 - DNA, 20 bp, synthetic construct
  source 1..20: mol_type = other DNA
cagtaaattactaatggtga

SEQ ID NO: 1409 - DNA, 20 bp, synthetic construct
  source 1..20: mol_type = other DNA
acagtaaattactaatggtg

SEQ ID NO: 1410 - DNA, 20 bp, synthetic construct
  source 1..20: mol_type = other DNA
tacagtaaattactaatggt

SEQ ID NO: 1411 - DNA, 20 bp, synthetic construct
  source 1..20: mol_type = other DNA
ttcagtacctaaaataagtt

SEQ ID NO: 1412 - DNA, 20 bp, synthetic construct
  source 1..20: mol_type = other DNA
ccctcattttcagtacctaa

SEQ ID NO: 1413 - DNA, 20 bp, synthetic construct
  source 1..20: mol_type = other DNA
gtataaaacatttagtctcc

SEQ ID NO: 1414 - DNA, 20 bp, synthetic construct
  source 1..20: mol_type = other DNA
tgtataaaacatttagtctc

SEQ ID NO: 1415 - DNA, 20 bp, synthetic construct
  source 1..20: mol_type = other DNA
ctgtataaaacatttagtct

SEQ ID NO: 1416 - DNA, 20 bp, synthetic construct
  source 1..20: mol_type = other DNA
actgtataaaacatttagtc

SEQ ID NO: 1417 - DNA, 20 bp, synthetic construct
  source 1..20: mol_type = other DNA
aatctcatattttactaaaa

SEQ ID NO: 1418 - DNA, 20 bp, synthetic construct
  source 1..20: mol_type = other DNA
caaatgcatcaaatctcata

SEQ ID NO: 1419 - DNA, 20 bp, synthetic construct
  source 1..20: mol_type = other DNA
atcatctatcaaatgcatca

SEQ ID NO: 1420 - DNA, 20 bp, synthetic construct
  source 1..20: mol_type = other DNA
tattttaaacaaacatcatc

SEQ ID NO: 1421 - DNA, 20 bp, synthetic construct
  source 1..20: mol_type = other DNA
agaattattttaaacaaaca

SEQ ID NO: 1422 - DNA, 20 bp, synthetic construct
  source 1..20: mol_type = other DNA
aagaattattttaaacaaac

SEQ ID NO: 1423 - DNA, 20 bp, synthetic construct
  source 1..20: mol_type = other DNA
tcaaaaatttaagaattatt

SEQ ID NO: 1424 - DNA, 20 bp, synthetic construct
  source 1..20: mol_type = other DNA
atcaaaaatttaagaattat

SEQ ID NO: 1425 - DNA, 20 bp, synthetic construct
  source 1..20: mol_type = other DNA
tgatcaaaaatttaagaatt

SEQ ID NO: 1426 - DNA, 20 bp, synthetic construct
  source 1..20: mol_type = other DNA
atgatcaaaaatttaagaat

SEQ ID NO: 1427 - DNA, 20 bp, synthetic construct
  source 1..20: mol_type = other DNA
catgatcaaaaatttaagaa

SEQ ID NO: 1428 - DNA, 20 bp, synthetic construct
  source 1..20: mol_type = other DNA
tacatgatcaaaaatttaag

SEQ ID NO: 1429 - DNA, 20 bp, synthetic construct
  source 1..20: mol_type = other DNA
ttaatgaaactataattaca

SEQ ID NO: 1430 - DNA, 20 bp, synthetic construct
  source 1..20: mol_type = other DNA
catgcattttcatttggtaa

SEQ ID NO: 1431 - DNA, 20 bp, synthetic construct
  source 1..20: mol_type = other DNA
ttgaactgaactttcagctt

SEQ ID NO: 1432 - DNA, 20 bp, synthetic construct
  source 1..20: mol_type = other DNA
atacggtttcacaatgttag

SEQ ID NO: 1433 - DNA, 20 bp, synthetic construct
  source 1..20: mol_type = other DNA
ctaaataatttaatcattaa

SEQ ID NO: 1434 - DNA, 20 bp, synthetic construct
  source 1..20: mol_type = other DNA
ccctaaataatttaatcatt

SEQ ID NO: 1435 - DNA, 20 bp, synthetic construct
  source 1..20: mol_type = other DNA
tcccctaaataatttaatca

SEQ ID NO: 1436 - DNA, 20 bp, synthetic construct
  source 1..20: mol_type = other DNA
cggctcccctaaataattta

SEQ ID NO: 1437 - DNA, 20 bp, synthetic construct
  source 1..20: mol_type = other DNA
atcttcccctaaataatttt

SEQ ID NO: 1438 - DNA, 20 bp, synthetic construct
  source 1..20: mol_type = other DNA
agaaaaaattaaaatgtgac

SEQ ID NO: 1439 - DNA, 20 bp, synthetic construct
  source 1..20: mol_type = other DNA
tgctaatatttccaaaagaa

SEQ ID NO: 1440 - DNA, 20 bp, synthetic construct
  source 1..20: mol_type = other DNA
ttgctaatatttccaaaaga

SEQ ID NO: 1441 - DNA, 20 bp, synthetic construct
  source 1..20: mol_type = other DNA
aaagtgagccttcttgctaa

SEQ ID NO: 1442 - DNA, 20 bp, synthetic construct
  source 1..20: mol_type = other DNA
agtgagtttaaaatcagtac

SEQ ID NO: 1443 - DNA, 20 bp, synthetic construct
  source 1..20: mol_type = other DNA
tagtgagtttaaaatcagta

SEQ ID NO: 1444 - DNA, 20 bp, synthetic construct
  source 1..20: mol_type = other DNA
tatccacatttttaaaagaa

SEQ ID NO: 1445 - DNA, 20 bp, synthetic construct
  source 1..20: mol_type = other DNA
cagtcagatccctataggaa

SEQ ID NO: 1446 - DNA, 20 bp, synthetic construct
  source 1..20: mol_type = other DNA
ttcaccagtcagatccctat

SEQ ID NO: 1447 - DNA, 20 bp, synthetic construct
  source 1..20: mol_type = other DNA
ataattcaccagtcagatcc

SEQ ID NO: 1448 - DNA, 20 bp, synthetic construct
  source 1..20: mol_type = other DNA
ttataattcaccagtcagat

SEQ ID NO: 1449 - DNA, 20 bp, synthetic construct
  source 1..20: mol_type = other DNA
gttataattcaccagtcaga

SEQ ID NO: 1450 - DNA, 20 bp, synthetic construct
  source 1..20: mol_type = other DNA
agttataattcaccagtcag

SEQ ID NO: 1451 - DNA, 20 bp, synthetic construct
  source 1..20: mol_type = other DNA
cagttataattcaccagtca

SEQ ID NO: 1452 - DNA, 20 bp, synthetic construct
  source 1..20: mol_type = other DNA
acagttataattcaccagtc

SEQ ID NO: 1453 - DNA, 20 bp, synthetic construct
  source 1..20: mol_type = other DNA
tcccatttccaaagttaaca

SEQ ID NO: 1454 - DNA, 20 bp, synthetic construct
  source 1..20: mol_type = other DNA
gtgcatatttaaaacaatat

SEQ ID NO: 1455 - DNA, 20 bp, synthetic construct
  source 1..20: mol_type = other DNA
aggatacaaactgtcattag

SEQ ID NO: 1456 - DNA, 20 bp, synthetic construct
  source 1..20: mol_type = other DNA
agaaggatacaaactgtcat

SEQ ID NO: 1457 - DNA, 20 bp, synthetic construct
  source 1..20: mol_type = other DNA
ctgttaattttgacaggtag

SEQ ID NO: 1458 - DNA, 20 bp, synthetic construct
  source 1..20: mol_type = other DNA
ctgctgttaattttgacagg

SEQ ID NO: 1459 - DNA, 20 bp, synthetic construct
  source 1..20: mol_type = other DNA
gactacttacctgaatagag

SEQ ID NO: 1460 - DNA, 20 bp, synthetic construct
  source 1..20: mol_type = other DNA
cttgtgactacttacctgaa

SEQ ID NO: 1461 - DNA, 20 bp, synthetic construct
  source 1..20: mol_type = other DNA
tgtaagcaacacatagtaca

SEQ ID NO: 1462 - DNA, 20 bp, synthetic construct
  source 1..20: mol_type = other DNA
gagtataatctatactctgt

SEQ ID NO: 1463 - DNA, 20 bp, synthetic construct
  source 1..20: mol_type = other DNA
tatataaaaatctagtactc

SEQ ID NO: 1464 - DNA, 20 bp, synthetic construct
  source 1..20: mol_type = other DNA
atctatataaaaatctagta

SEQ ID NO: 1465 - DNA, 20 bp, synthetic construct
  source 1..20: mol_type = other DNA
tatctatataaaaatctagt

SEQ ID NO: 1466 - DNA, 20 bp, synthetic construct
  source 1..20: mol_type = other DNA
ttcatgtttatctatataaa

SEQ ID NO: 1467 - DNA, 20 bp, synthetic construct
  source 1..20: mol_type = other DNA
caatcctttcatgtttatct

SEQ ID NO: 1468 - DNA, 20 bp, synthetic construct
  source 1..20: mol_type = other DNA
tctacaatcctttcatgttt

SEQ ID NO: 1469 - DNA, 20 bp, synthetic construct
  source 1..20: mol_type = other DNA
ttctacaatcctttcatgtt

SEQ ID NO: 1470 - DNA, 20 bp, synthetic construct
  source 1..20: mol_type = other DNA
attctacaatcctttcatgt

SEQ ID NO: 1471 - DNA, 20 bp, synthetic construct
  source 1..20: mol_type = other DNA
aggaatttttaaatgcccca

SEQ ID NO: 1472 - DNA, 20 bp, synthetic construct
  source 1..20: mol_type = other DNA
aaggaatttttaaatgcccc

SEQ ID NO: 1473 - DNA, 20 bp, synthetic construct
  source 1..20: mol_type = other DNA
gaaggaatttttaaatgccc

SEQ ID NO: 1474 - DNA, 20 bp, synthetic construct
  source 1..20: mol_type = other DNA
agaaggaatttttaaatgcc

SEQ ID NO: 1475 - DNA, 20 bp, synthetic construct
  source 1..20: mol_type = other DNA
taaggttattattagcatcc

SEQ ID NO: 1476 - DNA, 20 bp, synthetic construct
  source 1..20: mol_type = other DNA
attaaggttattattagcat

SEQ ID NO: 1477 - DNA, 20 bp, synthetic construct
  source 1..20: mol_type = other DNA
ctcaaatttacccaacagat

SEQ ID NO: 1478 - DNA, 20 bp, synthetic construct
  source 1..20: mol_type = other DNA
ttttctcaaatttacccaac

SEQ ID NO: 1479 - DNA, 20 bp, synthetic construct
  source 1..20: mol_type = other DNA
ggctgatttaaaaggatggt

SEQ ID NO: 1480 - DNA, 20 bp, synthetic construct
  source 1..20: mol_type = other DNA
aggctgatttaaaaggatgg

SEQ ID NO: 1481 - DNA, 20 bp, synthetic construct
  source 1..20: mol_type = other DNA
ggtaggctgatttaaaagga

SEQ ID NO: 1482 - DNA, 20 bp, synthetic construct
  source 1..20: mol_type = other DNA
aaggaaatccagtctggtag

SEQ ID NO: 1483 - DNA, 20 bp, synthetic construct
  source 1..20: mol_type = other DNA
ataaggaaatccagtctggt

SEQ ID NO: 1484 - DNA, 20 bp, synthetic construct
  source 1..20: mol_type = other DNA
gccacaaaccataataagga

SEQ ID NO: 1485 - DNA, 20 bp, synthetic construct
  source 1..20: mol_type = other DNA
aaatcaaaagccacaaacca

SEQ ID NO: 1486 - DNA, 20 bp, synthetic construct
  source 1..20: mol_type = other DNA
agagctatacattaaaaaaa

SEQ ID NO: 1487 - DNA, 20 bp, synthetic construct
  source 1..20: mol_type = other DNA
caaagaattcaaagagagct

SEQ ID NO: 1488 - DNA, 20 bp, synthetic construct
  source 1..20: mol_type = other DNA
accaccaaagaattcaaaga

SEQ ID NO: 1489 - DNA, 20 bp, synthetic construct
  source 1..20: mol_type = other DNA
tataaccaccaaagaattca

SEQ ID NO: 1490 - DNA, 20 bp, synthetic construct
  source 1..20: mol_type = other DNA
atatataaccaccaaagaat

SEQ ID NO: 1491 - DNA, 20 bp, synthetic construct
  source 1..20: mol_type = other DNA
atatatataaccaccaaaga

SEQ ID NO: 1492 - DNA, 20 bp, synthetic construct
  source 1..20: mol_type = other DNA
tacatatatatataaccacc

SEQ ID NO: 1493 - DNA, 20 bp, synthetic construct
  source 1..20: mol_type = other DNA
agtacatatatatataacca

SEQ ID NO: 1494 - DNA, 20 bp, synthetic construct
  source 1..20: mol_type = other DNA
cagataaaagaatcttgcga

SEQ ID NO: 1495 - DNA, 20 bp, synthetic construct
  source 1..20: mol_type = other DNA
ttagaaaaagaatgaaagac

SEQ ID NO: 1496 - DNA, 20 bp, synthetic construct
  source 1..20: mol_type = other DNA
ctggatacaactcacagtgt

SEQ ID NO: 1497 - DNA, 20 bp, synthetic construct
  source 1..20: mol_type = other DNA
tgcagtagccattacctgtt

SEQ ID NO: 1498 - DNA, 20 bp, synthetic construct
  source 1..20: mol_type = other DNA
aacaggcaccaagagcagca

SEQ ID NO: 1499 - DNA, 20 bp, synthetic construct
  source 1..20: mol_type = other DNA
ggtagccaacaaagaagcaa

SEQ ID NO: 1500 - DNA, 20 bp, synthetic construct
  source 1..20: mol_type = other DNA
caaggtagccaacaaagaag

SEQ ID NO: 1501 - DNA, 20 bp, synthetic construct
  source 1..20: mol_type = other DNA
tccaaggtagccaacaaaga

SEQ ID NO: 1502 - DNA, 20 bp, synthetic construct
  source 1..20: mol_type = other DNA
ctgaaaattcactatctgcc

SEQ ID NO: 1503 - DNA, 20 bp, synthetic construct
  source 1..20: mol_type = other DNA
tttctgaaaattcactatct

SEQ ID NO: 1504 - DNA, 20 bp, synthetic construct
  source 1..20: mol_type = other DNA
aaatttctgaaaattcacta

SEQ ID NO: 1505 - DNA, 20 bp, synthetic construct
  source 1..20: mol_type = other DNA
aaatgcaaacctgtttattt

SEQ ID NO: 1506 - DNA, 20 bp, synthetic construct
  source 1..20: mol_type = other DNA
ctgggcatttaaactgaagg

SEQ ID NO: 1507 - DNA, 20 bp, synthetic construct
  source 1..20: mol_type = other DNA
tctaccaaaataagttctcc

SEQ ID NO: 1508 - DNA, 20 bp, synthetic construct
  source 1..20: mol_type = other DNA
catatctaccaaaataagtt

SEQ ID NO: 1509 - DNA, 20 bp, synthetic construct
  source 1..20: mol_type = other DNA
aaaattatattcaacttgct

SEQ ID NO: 1510 - DNA, 20 bp, synthetic construct
  source 1..20: mol_type = other DNA
tgggtgctactttagaaaaa

SEQ ID NO: 1511 - DNA, 20 bp, synthetic construct
  source 1..20: mol_type = other DNA
gtctactatatacatctgat

SEQ ID NO: 1512 - DNA, 20 bp, synthetic construct
  source 1..20: mol_type = other DNA
ctagtctactatatacatct

SEQ ID NO: 1513 - DNA, 20 bp, synthetic construct
  source 1..20: mol_type = other DNA
actagtctactatatacatc

SEQ ID NO: 1514 - DNA, 20 bp, synthetic construct
  source 1..20: mol_type = other DNA
ttaaaactagtctactatat

SEQ ID NO: 1515 - DNA, 20 bp, synthetic construct
  source 1..20: mol_type = other DNA
atattctacccataagtgct

SEQ ID NO: 1516 - DNA, 20 bp, synthetic construct
  source 1..20: mol_type = other DNA
tgtatattctacccataagt

SEQ ID NO: 1517 - DNA, 20 bp, synthetic construct
  source 1..20: mol_type = other DNA
tcaaaaatccagatgtatat

SEQ ID NO: 1518 - DNA, 20 bp, synthetic construct
  source 1..20: mol_type = other DNA
cctcaaaaatccagatgtat

SEQ ID NO: 1519 - DNA, 20 bp, synthetic construct
  source 1..20: mol_type = other DNA
gcctcaaaaatccagatgta

SEQ ID NO: 1520 - DNA, 20 bp, synthetic construct
  source 1..20: mol_type = other DNA
cacaattcctaaataaaact

SEQ ID NO: 1521 - DNA, 20 bp, synthetic construct
  source 1..20: mol_type = other DNA
cacacaattcctaaataaaa

SEQ ID NO: 1522 - DNA, 20 bp, synthetic construct
  source 1..20: mol_type = other DNA
ccagaaaaccacacaattcc

SEQ ID NO: 1523 - DNA, 20 bp, synthetic construct
  source 1..20: mol_type = other DNA
tccagaaaaccacacaattc

SEQ ID NO: 1524 - DNA, 20 bp, synthetic construct
  source 1..20: mol_type = other DNA
ttccagaaaaccacacaatt

SEQ ID NO: 1525 - DNA, 20 bp, synthetic construct
  source 1..20: mol_type = other DNA
atgttccagaaaaccacaca

SEQ ID NO: 1526 - DNA, 20 bp, synthetic construct
  source 1..20: mol_type = other DNA
gagatgttccagaaaaccac

SEQ ID NO: 1527 - DNA, 20 bp, synthetic construct
  source 1..20: mol_type = other DNA
agtgcttttcataccaggtc

SEQ ID NO: 1528 - DNA, 20 bp, synthetic construct
  source 1..20: mol_type = other DNA
gagtgcttttcataccaggt

SEQ ID NO: 1529 - DNA, 20 bp, synthetic construct
  source 1..20: mol_type = other DNA
cactaaatccataaaaaaaa

SEQ ID NO: 1530 - DNA, 20 bp, synthetic construct
  source 1..20: mol_type = other DNA
atcactaaatccataaaaaa

SEQ ID NO: 1531 - DNA, 20 bp, synthetic construct
  source 1..20: mol_type = other DNA
agatatatcactaaatccat

SEQ ID NO: 1532 - DNA, 20 bp, synthetic construct
  source 1..20: mol_type = other DNA
atagatatatcactaaatcc

SEQ ID NO: 1533 - DNA, 20 bp, synthetic construct
  source 1..20: mol_type = other DNA
tatagatatatcactaaatc

SEQ ID NO: 1534 - DNA, 20 bp, synthetic construct
  source 1..20: mol_type = other DNA
tgtgtatagatatatcacta

SEQ ID NO: 1535 - DNA, 20 bp, synthetic construct
  source 1..20: mol_type = other DNA
gtgtgtatagatatatcact

SEQ ID NO: 1536 - DNA, 20 bp, synthetic construct
  source 1..20: mol_type = other DNA
tataggttttaaaaagtgtg

SEQ ID NO: 1537 - DNA, 20 bp, synthetic construct
  source 1..20: mol_type = other DNA
tataaatttctctagaaggc

SEQ ID NO: 1538 - DNA, 20 bp, synthetic construct
  source 1..20: mol_type = other DNA
atataaatttctctagaagg

SEQ ID NO: 1539 - DNA, 20 bp, synthetic construct
  source 1..20: mol_type = other DNA
tcatatataaatttctctag

SEQ ID NO: 1540 - DNA, 20 bp, synthetic construct
  source 1..20: mol_type = other DNA
ccattccaaatttaggaagt

SEQ ID NO: 1541 - DNA, 20 bp, synthetic construct
  source 1..20: mol_type = other DNA
actccattccaaatttagga

SEQ ID NO: 1542 - DNA, 20 bp, synthetic construct
  source 1..20: mol_type = other DNA
agcaacttttcataagctaa

SEQ ID NO: 1543 - DNA, 20 bp, synthetic construct
  source 1..20: mol_type = other DNA
tgcttataacctgttaagaa

SEQ ID NO: 1544 - DNA, 20 bp, synthetic construct
  source 1..20: mol_type = other DNA
gaaatgcaaaacagaatctt

SEQ ID NO: 1545 - DNA, 20 bp, synthetic construct
  source 1..20: mol_type = other DNA
ttacaactttaaaaatcaaa

SEQ ID NO: 1546 - DNA, 20 bp, synthetic construct
  source 1..20: mol_type = other DNA
tttaagaaattacaacttta

SEQ ID NO: 1547 - DNA, 20 bp, synthetic construct
  source 1..20: mol_type = other DNA
agtattcaaaatgtatttct

SEQ ID NO: 1548 - DNA, 20 bp, synthetic construct
  source 1..20: mol_type = other DNA
gaacatcaaaacaaaagtat

SEQ ID NO: 1549 - DNA, 20 bp, synthetic construct
  source 1..20: mol_type = other DNA
cacaaaggtgaaataggaaa

SEQ ID NO: 1550 - DNA, 20 bp, synthetic construct
  source 1..20: mol_type = other DNA
atcacacaaccatatgaacg

SEQ ID NO: 1551 - DNA, 20 bp, synthetic construct
  source 1..20: mol_type = other DNA
ttttaaaagatcacacaacc

SEQ ID NO: 1552 - DNA, 20 bp, synthetic construct
  source 1..20: mol_type = other DNA
gtttttaaaagatcacacaa

SEQ ID NO: 1553 - DNA, 20 bp, synthetic construct
  source 1..20: mol_type = other DNA
gatgtttttaaaagatcaca

SEQ ID NO: 1554 - DNA, 20 bp, synthetic construct
  source 1..20: mol_type = other DNA
actgatgtttttaaaagatc

SEQ ID NO: 1555 - DNA, 20 bp, synthetic construct
  source 1..20: mol_type = other DNA
cactgatgtttttaaaagat

SEQ ID NO: 1556 - DNA, 20 bp, synthetic construct
  source 1..20: mol_type = other DNA
aagattatatttatagttaa

SEQ ID NO: 1557 - DNA, 20 bp, synthetic construct
  source 1..20: mol_type = other DNA
taagattatatttatagtta

SEQ ID NO: 1558 - DNA, 20 bp, synthetic construct
  source 1..20: mol_type = other DNA
gtgataatttaagattatat

SEQ ID NO: 1559 - DNA, 20 bp, synthetic construct
  source 1..20: mol_type = other DNA
tttgtgataatttaagatta

SEQ ID NO: 1560 - DNA, 20 bp, synthetic construct
  source 1..20: mol_type = other DNA
aaaatttgtgataatttaag

SEQ ID NO: 1561 - DNA, 20 bp, synthetic construct
  source 1..20: mol_type = other DNA
gcaaatattatataaaattt

SEQ ID NO: 1562 - DNA, 20 bp, synthetic construct
  source 1..20: mol_type = other DNA
tggcaaatattatataaaat

SEQ ID NO: 1563 - DNA, 20 bp, synthetic construct
  source 1..20: mol_type = other DNA
tgaattcatatttatgttgt

SEQ ID NO: 1564 - DNA, 20 bp, synthetic construct
  source 1..20: mol_type = other DNA
cttgaaatattgaattcata

SEQ ID NO: 1565 - DNA, 20 bp, synthetic construct
  source 1..20: mol_type = other DNA
gaaaacagacaatattaact

SEQ ID NO: 1566 - DNA, 20 bp, synthetic construct
  source 1..20: mol_type = other DNA
taaatgatctttcatttcta

SEQ ID NO: 1567 - DNA, 20 bp, synthetic construct
  source 1..20: mol_type = other DNA
acctgttttcctaattttct

SEQ ID NO: 1568 - DNA, 20 bp, synthetic construct
  source 1..20: mol_type = other DNA
aagggtaagaaatgttacct

SEQ ID NO: 1569 - DNA, 20 bp, synthetic construct
  source 1..20: mol_type = other DNA
tataagaaaaaaagacaagg

SEQ ID NO: 1570 - DNA, 20 bp, synthetic construct
  source 1..20: mol_type = other DNA
caatataagaaaaaaagaca

SEQ ID NO: 1571 - DNA, 20 bp, synthetic construct
  source 1..20: mol_type = other DNA
tggcccacattttagtttta

SEQ ID NO: 1572 - DNA, 20 bp, synthetic construct
  source 1..20: mol_type = other DNA
aattttaaagtcagcaatcc

SEQ ID NO: 1573 - DNA, 20 bp, synthetic construct
  source 1..20: mol_type = other DNA
tcctaattttaaagtcagca

SEQ ID NO: 1574 - DNA, 20 bp, synthetic construct
  source 1..20: mol_type = other DNA
ttcctaattttaaagtcagc

SEQ ID NO: 1575 - DNA, 20 bp, synthetic construct
  source 1..20: mol_type = other DNA
tttcctaattttaaagtcag

SEQ ID NO: 1576 - DNA, 20 bp, synthetic construct
  source 1..20: mol_type = other DNA
gtttcctaattttaaagtca

SEQ ID NO: 1577 - DNA, 20 bp, synthetic construct
  source 1..20: mol_type = other DNA
ggtcagtttcctaattttaa

SEQ ID NO: 1578 - DNA, 20 bp, synthetic construct
  source 1..20: mol_type = other DNA
aatgacaatttctatctatc

SEQ ID NO: 1579 - DNA, 20 bp, synthetic construct
  source 1..20: mol_type = other DNA
gatattatcttttaaaatga

SEQ ID NO: 1580 - DNA, 20 bp, synthetic construct
  source 1..20: mol_type = other DNA
cacaaataaatttataagga

SEQ ID NO: 1581 - DNA, 20 bp, synthetic construct
  source 1..20: mol_type = other DNA
acttgtcacaaataaattta

SEQ ID NO: 1582 - DNA, 20 bp, synthetic construct
  source 1..20: mol_type = other DNA
tacttgtcacaaataaattt

SEQ ID NO: 1583 - DNA, 20 bp, synthetic construct
  source 1..20: mol_type = other DNA
atagttaaattgcatatact

SEQ ID NO: 1584 - DNA, 20 bp, synthetic construct
  source 1..20: mol_type = other DNA
tgatatagttaaattgcata

SEQ ID NO: 1585 - DNA, 20 bp, synthetic construct
  source 1..20: mol_type = other DNA
ttttcttatgatatagttaa

SEQ ID NO: 1586 - DNA, 20 bp, synthetic construct
  source 1..20: mol_type = other DNA
tagaatttttcttatgatat

SEQ ID NO: 1587 - DNA, 20 bp, synthetic construct
  source 1..20: mol_type = other DNA
atagaatttttcttatgata

SEQ ID NO: 1588 - DNA, 20 bp, synthetic construct
  source 1..20: mol_type = other DNA
taatatagaatttttcttat

SEQ ID NO: 1589 - DNA, 20 bp, synthetic construct
  source 1..20: mol_type = other DNA
ttgtattatctttaatatag

SEQ ID NO: 1590 - DNA, 20 bp, synthetic construct
  source 1..20: mol_type = other DNA
acataaaaacccacttaaaa

SEQ ID NO: 1591 - DNA, 20 bp, synthetic construct
  source 1..20: mol_type = other DNA
catcacataaaaacccactt

SEQ ID NO: 1592 - DNA, 20 bp, synthetic construct
  source 1..20: mol_type = other DNA
gaacatagtcatcacataaa

SEQ ID NO: 1593 - DNA, 20 bp, synthetic construct
  source 1..20: mol_type = other DNA
cagaacatagtcatcacata

SEQ ID NO: 1594 - DNA, 20 bp, synthetic construct
  source 1..20: mol_type = other DNA
tgctaaatacaaatctataa

SEQ ID NO: 1595 - DNA, 20 bp, synthetic construct
  source 1..20: mol_type = other DNA
tatgctaaatacaaatctat

SEQ ID NO: 1596 - DNA, 20 bp, synthetic construct
  source 1..20: mol_type = other DNA
ctatgctaaatacaaatcta

SEQ ID NO: 1597 - DNA, 20 bp, synthetic construct
  source 1..20: mol_type = other DNA
actatgctaaatacaaatct

SEQ ID NO: 1598 - DNA, 20 bp, synthetic construct
  source 1..20: mol_type = other DNA
acactatttcaggctttgtg

SEQ ID NO: 1599 - DNA, 20 bp, synthetic construct
  source 1..20: mol_type = other DNA
atgctttattcatgcttgac

SEQ ID NO: 1600 - DNA, 20 bp, synthetic construct
  source 1..20: mol_type = other DNA
ataatcttacactaaagcaa

SEQ ID NO: 1601 - DNA, 20 bp, synthetic construct
  source 1..20: mol_type = other DNA
tgaataatcttacactaaag

SEQ ID NO: 1602 - DNA, 20 bp, synthetic construct
  source 1..20: mol_type = other DNA
atgaataatcttacactaaa

SEQ ID NO: 1603 - DNA, 20 bp, synthetic construct
  source 1..20: mol_type = other DNA
aatcataatgaataatctta

SEQ ID NO: 1604 - DNA, 20 bp, synthetic construct
  source 1..20: mol_type = other DNA
agacatatttcatgttttat

SEQ ID NO: 1605 - DNA, 20 bp, synthetic construct
  source 1..20: mol_type = other DNA
aagacatatttcatgtttta

SEQ ID NO: 1606 - DNA, 20 bp, synthetic construct
  source 1..20: mol_type = other DNA
caagacatatttcatgtttt

SEQ ID NO: 1607 - DNA, 20 bp, synthetic construct
  source 1..20: mol_type = other DNA
ttgctcaagacatatttcat

SEQ ID NO: 1608 - DNA, 20 bp, synthetic construct
  source 1..20: mol_type = other DNA
cttgctcaagacatatttca

SEQ ID NO: 1609 - DNA, 20 bp, synthetic construct
  source 1..20: mol_type = other DNA
tgtttcttaaaatagcttgc

SEQ ID NO: 1610 - DNA, 20 bp, synthetic construct
  source 1..20: mol_type = other DNA
ttcaaaattctaataacaag

SEQ ID NO: 1611 - DNA, 20 bp, synthetic construct
  source 1..20: mol_type = other DNA
agattcaaaattctaataac

SEQ ID NO: 1612 - DNA, 20 bp, synthetic construct
  source 1..20: mol_type = other DNA
ctctttcaaagattcaaaat

SEQ ID NO: 1613 - DNA, 20 bp, synthetic construct
  source 1..20: mol_type = other DNA
accctctttcaaagattcaa

SEQ ID NO: 1614 - DNA, 20 bp, synthetic construct
  source 1..20: mol_type = other DNA
ttcaataaccctctttcaaa

SEQ ID NO: 1615 - DNA, 20 bp, synthetic construct
  source 1..20: mol_type = other DNA
taaatgataccatacagcag

SEQ ID NO: 1616 - DNA, 20 bp, synthetic construct
  source 1..20: mol_type = other DNA
ttaataaatgataccataca

SEQ ID NO: 1617 - DNA, 20 bp, synthetic construct
  source 1..20: mol_type = other DNA
tttctagacttttaataaat

SEQ ID NO: 1618 - DNA, 20 bp, synthetic construct
  source 1..20: mol_type = other DNA
tactacaaccaagatagtga

SEQ ID NO: 1619 - DNA, 20 bp, synthetic construct
  source 1..20: mol_type = other DNA
tactgtactcccatgaaacc

SEQ ID NO: 1620 - DNA, 20 bp, synthetic construct
  source 1..20: mol_type = other DNA
catttgtatactgtactccc

SEQ ID NO: 1621 - DNA, 20 bp, synthetic construct
  source 1..20: mol_type = other DNA
ttggcttgtatttacatttt

SEQ ID NO: 1622 - DNA, 20 bp, synthetic construct
  source 1..20: mol_type = other DNA
agatttaattcaatatattt

SEQ ID NO: 1623 - DNA, 20 bp, synthetic construct
  source 1..20: mol_type = other DNA
ctcttacagatttaattcaa

SEQ ID NO: 1624 - DNA, 20 bp, synthetic construct
  source 1..20: mol_type = other DNA
tgtttttgaattatctctta

SEQ ID NO: 1625 - DNA, 20 bp, synthetic construct
  source 1..20: mol_type = other DNA
aaaagataacaatagggttt

SEQ ID NO: 1626 - DNA, 20 bp, synthetic construct
  source 1..20: mol_type = other DNA
taaaagataacaatagggtt

SEQ ID NO: 1627 - DNA, 20 bp, synthetic construct
  source 1..20: mol_type = other DNA
acttaaaagataacaatagg

SEQ ID NO: 1628 - DNA, 20 bp, synthetic construct
  source 1..20: mol_type = other DNA
tgacttaaaagataacaata

SEQ ID NO: 1629 - DNA, 20 bp, synthetic construct
  source 1..20: mol_type = other DNA
tgggtgacttaaaagataac

SEQ ID NO: 1630 - DNA, 20 bp, synthetic construct
  source 1..20: mol_type = other DNA
atttgggtgacttaaaagat

SEQ ID NO: 1631 - DNA, 20 bp, synthetic construct
  source 1..20: mol_type = other DNA
gacttttcccaaatttgatt

SEQ ID NO: 1632 - DNA, 20 bp, synthetic construct
  source 1..20: mol_type = other DNA
gtgacttttcccaaatttga

SEQ ID NO: 1633 - DNA, 20 bp, synthetic construct
  source 1..20: mol_type = other DNA
ttaagaaagaaccaacttag

SEQ ID NO: 1634 - DNA, 20 bp, synthetic construct
  source 1..20: mol_type = other DNA
caggaagaactttaagaaag

SEQ ID NO: 1635 - DNA, 20 bp, synthetic construct
  source 1..20: mol_type = other DNA
gttacatctccttaacttgc

SEQ ID NO: 1636 - DNA, 20 bp, synthetic construct
  source 1..20: mol_type = other DNA
ccagctagcctccactgtaa

SEQ ID NO: 1637 - DNA, 20 bp, synthetic construct
  source 1..20: mol_type = other DNA
acccagctagcctccactgt

SEQ ID NO: 1638 - DNA, 20 bp, synthetic construct
  source 1..20: mol_type = other DNA
ttaaataatctcagcagtac

SEQ ID NO: 1639 - DNA, 20 bp, synthetic construct
  source 1..20: mol_type = other DNA
gaggttaaataatctcagca

SEQ ID NO: 1640 - DNA, 20 bp, synthetic construct
  source 1..20: mol_type = other DNA
agaggttaaataatctcagc

SEQ ID NO: 1641 - DNA, 20 bp, synthetic construct
  source 1..20: mol_type = other DNA
cagaggttaaataatctcag

SEQ ID NO: 1642 - DNA, 20 bp, synthetic construct
  source 1..20: mol_type = other DNA
ccagaggttaaataatctca

SEQ ID NO: 1643 - DNA, 20 bp, synthetic construct
  source 1..20: mol_type = other DNA
cccagaggttaaataatctc

SEQ ID NO: 1644 - DNA, 20 bp, synthetic construct
  source 1..20: mol_type = other DNA
aaataaaacccagaggttaa

SEQ ID NO: 1645 - DNA, 20 bp, synthetic construct
  source 1..20: mol_type = other DNA
taaataaaacccagaggtta

SEQ ID NO: 1646 - DNA, 20 bp, synthetic construct
  source 1..20: mol_type = other DNA
ataaataaaacccagaggtt

SEQ ID NO: 1647 - DNA, 20 bp, synthetic construct
  source 1..20: mol_type = other DNA
gcttactttatacaaaaaaa

SEQ ID NO: 1648 - DNA, 20 bp, synthetic construct
  source 1..20: mol_type = other DNA
gtgcttactttatacaaaaa

SEQ ID NO: 1649 - DNA, 20 bp, synthetic construct
  source 1..20: mol_type = other DNA
cagtgcttactttatacaaa

SEQ ID NO: 1650 - DNA, 20 bp, synthetic construct
  source 1..20: mol_type = other DNA
ccttaaaaattcagtgctta

SEQ ID NO: 1651 - DNA, 20 bp, synthetic construct
  source 1..20: mol_type = other DNA
accttaaaaattcagtgctt

SEQ ID NO: 1652 - DNA, 20 bp, synthetic construct
  source 1..20: mol_type = other DNA
ttaatacaaccttaaaaatt

SEQ ID NO: 1653 - DNA, 20 bp, synthetic construct
  source 1..20: mol_type = other DNA
tgcaaattaatacaacctta

SEQ ID NO: 1654 - DNA, 20 bp, synthetic construct
  source 1..20: mol_type = other DNA
gacatttatttgcaaattaa

SEQ ID NO: 1655 - DNA, 20 bp, synthetic construct
  source 1..20: mol_type = other DNA
aagatagacatttatttgca

SEQ ID NO: 1656 - DNA, 20 bp, synthetic construct
  source 1..20: mol_type = other DNA
taagatagacatttatttgc

SEQ ID NO: 1657 - DNA, 20 bp, synthetic construct
  source 1..20: mol_type = other DNA
aataagatagacatttattt

SEQ ID NO: 1658 - DNA, 20 bp, synthetic construct
  source 1..20: mol_type = other DNA
aaaataataagatagacatt

SEQ ID NO: 1659 - DNA, 20 bp, synthetic construct
  source 1..20: mol_type = other DNA
ctcaaaataataagatagac

SEQ ID NO: 1660 - DNA, 20 bp, synthetic construct
  source 1..20: mol_type = other DNA
tctcaaaataataagataga

SEQ ID NO: 1661 - DNA, 20 bp, synthetic construct
  source 1..20: mol_type = other DNA
ctctcaaaataataagatag

SEQ ID NO: 1662 - DNA, 20 bp, synthetic construct
  source 1..20: mol_type = other DNA
aaaattttttaaatctctca

SEQ ID NO: 1663 - DNA, 20 bp, synthetic construct
  source 1..20: mol_type = other DNA
tcaaaatgtgaaaatgcaat

SEQ ID NO: 1664 - DNA, 20 bp, synthetic construct
  source 1..20: mol_type = other DNA
aaccaaaatttgacatcttc

SEQ ID NO: 1665 - DNA, 20 bp, synthetic construct
  source 1..20: mol_type = other DNA
ataaaccaaaatttgacatc

SEQ ID NO: 1666 - DNA, 20 bp, synthetic construct
  source 1..20: mol_type = other DNA
aaaataaaccaaaatttgac

SEQ ID NO: 1667 - DNA, 20 bp, synthetic construct
  source 1..20: mol_type = other DNA
atagtgaaaaatatagtttt

SEQ ID NO: 1668 - DNA, 20 bp, synthetic construct
  source 1..20: mol_type = other DNA
ctatagtgaaaaatatagtt

SEQ ID NO: 1669 - DNA, 20 bp, synthetic construct
  source 1..20: mol_type = other DNA
gtctatagtgaaaaatatag

SEQ ID NO: 1670 - DNA, 20 bp, synthetic construct
  source 1..20: mol_type = other DNA
ttcattatacagggacctcg

SEQ ID NO: 1671 - DNA, 20 bp, synthetic construct
  source 1..20: mol_type = other DNA
cttctttttcattatacagg

SEQ ID NO: 1672 - DNA, 20 bp, synthetic construct
  source 1..20: mol_type = other DNA
taatactttttccagccttc

SEQ ID NO: 1673 - DNA, 20 bp, synthetic construct
  source 1..20: mol_type = other DNA
gttaatactttttccagcct

SEQ ID NO: 1674 - DNA, 20 bp, synthetic construct
  source 1..20: mol_type = other DNA
atgttaatactttttccagc

SEQ ID NO: 1675 - DNA, 20 bp, synthetic construct
  source 1..20: mol_type = other DNA
aatgttaatactttttccag

SEQ ID NO: 1676 - DNA, 20 bp, synthetic construct
  source 1..20: mol_type = other DNA
acaatgttaatactttttcc

SEQ ID NO: 1677 - DNA, 20 bp, synthetic construct
  source 1..20: mol_type = other DNA
ggattttgacaatgttaata

SEQ ID NO: 1678 - DNA, 20 bp, synthetic construct
  source 1..20: mol_type = other DNA
cgatcaatatcatgaccaac

SEQ ID NO: 1679 - DNA, 20 bp, synthetic construct
  source 1..20: mol_type = other DNA
aaaaagtttctaaagttaac

SEQ ID NO: 1680 - DNA, 20 bp, synthetic construct
  source 1..20: mol_type = other DNA
cacaagatacaaaaagtttc

SEQ ID NO: 1681 - DNA, 20 bp, synthetic construct
  source 1..20: mol_type = other DNA
acccacaagatacaaaaagt

SEQ ID NO: 1682 - DNA, 20 bp, synthetic construct
  source 1..20: mol_type = other DNA
aacccacaagatacaaaaag

SEQ ID NO: 1683 - DNA, 20 bp, synthetic construct
  source 1..20: mol_type = other DNA
taacccacaagatacaaaaa

SEQ ID NO: 1684 - DNA, 20 bp, synthetic construct
  source 1..20: mol_type = other DNA
taatttaacccacaagatac

SEQ ID NO: 1685 - DNA, 20 bp, synthetic construct
  source 1..20: mol_type = other DNA
ctaatttaacccacaagata

SEQ ID NO: 1686 - DNA, 20 bp, synthetic construct
  source 1..20: mol_type = other DNA
aatcctaatttaacccacaa

SEQ ID NO: 1687 - DNA, 20 bp, synthetic construct
  source 1..20: mol_type = other DNA
gtaatcctaatttaacccac

SEQ ID NO: 1688 - DNA, 20 bp, synthetic construct
  source 1..20: mol_type = other DNA
catagtaatcctaatttaac

SEQ ID NO: 1689 - DNA, 20 bp, synthetic construct
  source 1..20: mol_type = other DNA
tcatttatcactaccacata

SEQ ID NO: 1690 - DNA, 20 bp, synthetic construct
  source 1..20: mol_type = other DNA
acatcatttatcactaccac

SEQ ID NO: 1691 - DNA, 20 bp, synthetic construct
  source 1..20: mol_type = other DNA
attaacatcatttatcacta

SEQ ID NO: 1692 - DNA, 20 bp, synthetic construct
  source 1..20: mol_type = other DNA
ctaattaacatcatttatca

SEQ ID NO: 1693 - DNA, 20 bp, synthetic construct
  source 1..20: mol_type = other DNA
cctaattaacatcatttatc

SEQ ID NO: 1694 - DNA, 20 bp, synthetic construct
  source 1..20: mol_type = other DNA
ccctaattaacatcatttat

SEQ ID NO: 1695 - DNA, 20 bp, synthetic construct
  source 1..20: mol_type = other DNA
gccctaattaacatcattta

SEQ ID NO: 1696 - DNA, 20 bp, synthetic construct
  source 1..20: mol_type = other DNA
cggccctaattaacatcatt

SEQ ID NO: 1697 - DNA, 20 bp, synthetic construct
  source 1..20: mol_type = other DNA
tcggccctaattaacatcat

SEQ ID NO: 1698 - DNA, 20 bp, synthetic construct
  source 1..20: mol_type = other DNA
ctcggccctaattaacatca

SEQ ID NO: 1699 - DNA, 20 bp, synthetic construct
  source 1..20: mol_type = other DNA
tgcactcggccctaattaac

SEQ ID NO: 1700 - DNA, 20 bp, synthetic construct
  source 1..20: mol_type = other DNA
ggtcttacactatgttgtac

SEQ ID NO: 1701 - DNA, 20 bp, synthetic construct
  source 1..20: mol_type = other DNA
cacatataacatataaacac

SEQ ID NO: 1702 - DNA, 20 bp, synthetic construct
  source 1..20: mol_type = other DNA
atcacatataacatataaac

SEQ ID NO: 1703 - DNA, 20 bp, synthetic construct
  source 1..20: mol_type = other DNA
cactatcacatataacatat

SEQ ID NO: 1704 - DNA, 20 bp, synthetic construct
  source 1..20: mol_type = other DNA
gtctctataatttaaaaatg

SEQ ID NO: 1705 - DNA, 20 bp, synthetic construct
  source 1..20: mol_type = other DNA
cagctcagtttttaaaaatc

SEQ ID NO: 1706 - DNA, 20 bp, synthetic construct
  source 1..20: mol_type = other DNA
tttataattaccagctcagt

SEQ ID NO: 1707 - DNA, 20 bp, synthetic construct
  source 1..20: mol_type = other DNA
gaatttataattaccagctc

SEQ ID NO: 1708 - DNA, 20 bp, synthetic construct
  source 1..20: mol_type = other DNA
aggaagagaatttataatta

SEQ ID NO: 1709 - DNA, 20 bp, synthetic construct
  source 1..20: mol_type = other DNA
tgtgagaaagtcagaagttc

SEQ ID NO: 1710 - DNA, 20 bp, synthetic construct
  source 1..20: mol_type = other DNA
tgtcaaaagattccaattgt

SEQ ID NO: 1711 - DNA, 20 bp, synthetic construct
  source 1..20: mol_type = other DNA
tttgtcaaaagattccaatt

SEQ ID NO: 1712 - DNA, 20 bp, synthetic construct
  source 1..20: mol_type = other DNA
aatttttgtcaaaagattcc

SEQ ID NO: 1713 - DNA, 20 bp, synthetic construct
  source 1..20: mol_type = other DNA
aagttttcccattactgata

SEQ ID NO: 1714 - DNA, 20 bp, synthetic construct
  source 1..20: mol_type = other DNA
aaatgacaactacacaaagt

SEQ ID NO: 1715 - DNA, 20 bp, synthetic construct
  source 1..20: mol_type = other DNA
caacataactccaatcatat

SEQ ID NO: 1716 - DNA, 20 bp, synthetic construct
  source 1..20: mol_type = other DNA
tttttcaaaatatcagtcca

SEQ ID NO: 1717 - DNA, 20 bp, synthetic construct
  source 1..20: mol_type = other DNA
ttttttcaaaatatcagtcc

SEQ ID NO: 1718 - DNA, 20 bp, synthetic construct
  source 1..20: mol_type = other DNA
agctataattaaatcttttt

SEQ ID NO: 1719 - DNA, 20 bp, synthetic construct
  source 1..20: mol_type = other DNA
aatgtctttattaatagcta

SEQ ID NO: 1720 - DNA, 20 bp, synthetic construct
  source 1..20: mol_type = other DNA
aaatgtctttattaatagct

SEQ ID NO: 1721 - DNA, 20 bp, synthetic construct
  source 1..20: mol_type = other DNA
tcagtagtttaaatgtcttt

SEQ ID NO: 1722 - DNA, 20 bp, synthetic construct
  source 1..20: mol_type = other DNA
ctcccaaaagaataaaaatg

SEQ ID NO: 1723 - DNA, 20 bp, synthetic construct
  source 1..20: mol_type = other DNA
aaaccctcccaaaagaataa

SEQ ID NO: 1724 - DNA, 20 bp, synthetic construct
  source 1..20: mol_type = other DNA
acattaaaccctcccaaaag

SEQ ID NO: 1725 - DNA, 20 bp, synthetic construct
  source 1..20: mol_type = other DNA
aacattaaaccctcccaaaa

SEQ ID NO: 1726 - DNA, 20 bp, synthetic construct
  source 1..20: mol_type = other DNA
tataaacattaaaccctccc

SEQ ID NO: 1727 - DNA, 20 bp, synthetic construct
  source 1..20: mol_type = other DNA
actataaacattaaaccctc

SEQ ID NO: 1728 - DNA, 20 bp, synthetic construct
  source 1..20: mol_type = other DNA
aactataaacattaaaccct

SEQ ID NO: 1729 - DNA, 20 bp, synthetic construct
  source 1..20: mol_type = other DNA
tttaaactataaacattaaa

SEQ ID NO: 1730 - DNA, 20 bp, synthetic construct
  source 1..20: mol_type = other DNA
tgctttaaactataaacatt

SEQ ID NO: 1731 - DNA, 20 bp, synthetic construct
  source 1..20: mol_type = other DNA
ttgctttaaactataaacat

SEQ ID NO: 1732 - DNA, 20 bp, synthetic construct
  source 1..20: mol_type = other DNA
tttgctttaaactataaaca

SEQ ID NO: 1733 - DNA, 20 bp, synthetic construct
  source 1..20: mol_type = other DNA
agtttgctttaaactataaa

SEQ ID NO: 1734 - DNA, 20 bp, synthetic construct
  source 1..20: mol_type = other DNA
tatcactattaaatactttt

SEQ ID NO: 1735 - DNA, 20 bp, synthetic construct
  source 1..20: mol_type = other DNA
atactgcagatttatcacta

SEQ ID NO: 1736 - DNA, 20 bp, synthetic construct
  source 1..20: mol_type = other DNA
gactgaataatatgatctta

SEQ ID NO: 1737 - DNA, 20 bp, synthetic construct
  source 1..20: mol_type = other DNA
gaaatatttcaagttgagct

SEQ ID NO: 1738 - DNA, 20 bp, synthetic construct
  source 1..20: mol_type = other DNA
tggaaatatttcaagttgag

SEQ ID NO: 1739 - DNA, 20 bp, synthetic construct
  source 1..20: mol_type = other DNA
ctggaaatatttcaagttga

SEQ ID NO: 1740 - DNA, 20 bp, synthetic construct
  source 1..20: mol_type = other DNA
tctggaaatatttcaagttg

SEQ ID NO: 1741 - DNA, 20 bp, synthetic construct
  source 1..20: mol_type = other DNA
aagattgtttaaactctgga

SEQ ID NO: 1742 - DNA, 20 bp, synthetic construct
  source 1..20: mol_type = other DNA
agatacaacccatcaaagct

SEQ ID NO: 1743 - DNA, 20 bp, synthetic construct
  source 1..20: mol_type = other DNA
tagatacaacccatcaaagc

SEQ ID NO: 1744 - DNA, 20 bp, synthetic construct
  source 1..20: mol_type = other DNA
ttaagaatagatacaaccca

SEQ ID NO: 1745 - DNA, 20 bp, synthetic construct
  source 1..20: mol_type = other DNA
acatgttaagaatagataca

SEQ ID NO: 1746 - DNA, 20 bp, synthetic construct
  source 1..20: mol_type = other DNA
aggaagtttcacatgttaag

SEQ ID NO: 1747 - DNA, 20 bp, synthetic construct
  source 1..20: mol_type = other DNA
tgtcaatatttaagttagtg

SEQ ID NO: 1748 - DNA, 20 bp, synthetic construct
  source 1..20: mol_type = other DNA
ttgtcaatatttaagttagt

SEQ ID NO: 1749 - DNA, 20 bp, synthetic construct
  source 1..20: mol_type = other DNA
attgtcaatatttaagttag

SEQ ID NO: 1750 - DNA, 20 bp, synthetic construct
  source 1..20: mol_type = other DNA
ttcaagttaaaccactggaa

SEQ ID NO: 1751 - DNA, 20 bp, synthetic construct
  source 1..20: mol_type = other DNA
aattcaagttaaaccactgg

SEQ ID NO: 1752 - DNA, 20 bp, synthetic construct
  source 1..20: mol_type = other DNA
ttacttaccttcctgttgta

SEQ ID NO: 1753 - DNA, 20 bp, synthetic construct
  source 1..20: mol_type = other DNA
gtaacattacaaaatgttca

SEQ ID NO: 1754 - DNA, 20 bp, synthetic construct
  source 1..20: mol_type = other DNA
ttatttaactacttcgaaag

SEQ ID NO: 1755 - DNA, 20 bp, synthetic construct
  source 1..20: mol_type = other DNA
tgcctggttatttaactact

SEQ ID NO: 1756 - DNA, 20 bp, synthetic construct
  source 1..20: mol_type = other DNA
caaatcacagcctatcacca

SEQ ID NO: 1757 - DNA, 20 bp, synthetic construct
  source 1..20: mol_type = other DNA
cacccaaatcacagcctatc

SEQ ID NO: 1758 - DNA, 20 bp, synthetic construct
  source 1..20: mol_type = other DNA
tcacccaaatcacagcctat

SEQ ID NO: 1759 - DNA, 20 bp, synthetic construct
  source 1..20: mol_type = other DNA
gtcacccaaatcacagccta

SEQ ID NO: 1760 - DNA, 20 bp, synthetic construct
  source 1..20: mol_type = other DNA
agaaaaagccattacttaga

SEQ ID NO: 1761 - DNA, 20 bp, synthetic construct
  source 1..20: mol_type = other DNA
aaagaaaaagccattactta

SEQ ID NO: 1762 - DNA, 20 bp, synthetic construct
  source 1..20: mol_type = other DNA
catgtatttcaaagaaactg

SEQ ID NO: 1763 - DNA, 20 bp, synthetic construct
  source 1..20: mol_type = other DNA
caagggatagtttaatctag

SEQ ID NO: 1764 - DNA, 20 bp, synthetic construct
  source 1..20: mol_type = other DNA
gatcctaaaatcactgatga

SEQ ID NO: 1765 - DNA, 20 bp, synthetic construct
  source 1..20: mol_type = other DNA
agatcctaaaatcactgatg

SEQ ID NO: 1766 - DNA, 20 bp, synthetic construct
  source 1..20: mol_type = other DNA
tcagatcctaaaatcactga

SEQ ID NO: 1767 - DNA, 20 bp, synthetic construct
  source 1..20: mol_type = other DNA
gtcagatcctaaaatcactg

SEQ ID NO: 1768 - DNA, 20 bp, synthetic construct
  source 1..20: mol_type = other DNA
agtcagatcctaaaatcact

SEQ ID NO: 1769 - DNA, 20 bp, synthetic construct
  source 1..20: mol_type = other DNA
gacgatacagaaataattaa

SEQ ID NO: 1770 - DNA, 20 bp, synthetic construct
  source 1..20: mol_type = other DNA
aacatggtttaaagatagga

SEQ ID NO: 1771 - DNA, 20 bp, synthetic construct
  source 1..20: mol_type = other DNA
aacagacaaaacatggttta

SEQ ID NO: 1772 - DNA, 20 bp, synthetic construct
  source 1..20: mol_type = other DNA
gggtttaaagaatggctgga

SEQ ID NO: 1773 - DNA, 20 bp, synthetic construct
  source 1..20: mol_type = other DNA
agtagggtttaaagaatggc

SEQ ID NO: 1774 - DNA, 20 bp, synthetic construct
  source 1..20: mol_type = other DNA
caatggagtgattatgatga

SEQ ID NO: 1775 - DNA, 20 bp, synthetic construct
  source 1..20: mol_type = other DNA
tttgtcattcaagtatgatg

SEQ ID NO: 1776 - DNA, 20 bp, synthetic construct
  source 1..20: mol_type = other DNA
tggtttaaccagggttgaga

SEQ ID NO: 1777 - DNA, 20 bp, synthetic construct
  source 1..20: mol_type = other DNA
tatgttattttttagccacg

SEQ ID NO: 1778 - DNA, 20 bp, synthetic construct
  source 1..20: mol_type = other DNA
tttatgttattttttagcca

SEQ ID NO: 1779 - DNA, 20 bp, synthetic construct
  source 1..20: mol_type = other DNA
aaaccaatcatcatgtttta

SEQ ID NO: 1780 - DNA, 20 bp, synthetic construct
  source 1..20: mol_type = other DNA
aaaaccaatcatcatgtttt

SEQ ID NO: 1781 - DNA, 20 bp, synthetic construct
  source 1..20: mol_type = other DNA
taaaaccaatcatcatgttt

SEQ ID NO: 1782 - DNA, 20 bp, synthetic construct
  source 1..20: mol_type = other DNA
aaagtaaaaccaatcatcat

SEQ ID NO: 1783 - DNA, 20 bp, synthetic construct
  source 1..20: mol_type = other DNA
ggatagatcatttaagaaaa

SEQ ID NO: 1784 - DNA, 20 bp, synthetic construct
  source 1..20: mol_type = other DNA
atgagctgtgattatgctgc

SEQ ID NO: 1785 - DNA, 20 bp, synthetic construct
  source 1..20: mol_type = other DNA
aaagtaaaaccttagctagg

SEQ ID NO: 1786 - DNA, 20 bp, synthetic construct
  source 1..20: mol_type = other DNA
taaagtaaaaccttagctag

SEQ ID NO: 1787 - DNA, 20 bp, synthetic construct
  source 1..20: mol_type = other DNA
atttaaagtaaaaccttagc

SEQ ID NO: 1788 - DNA, 20 bp, synthetic construct
  source 1..20: mol_type = other DNA
taataaatttaaagtaaaac

SEQ ID NO: 1789 - DNA, 20 bp, synthetic construct
  source 1..20: mol_type = other DNA
gattataataaatttaaagt

SEQ ID NO: 1790 - DNA, 20 bp, synthetic construct
  source 1..20: mol_type = other DNA
ttgtgattataataaattta

SEQ ID NO: 1791 - DNA, 20 bp, synthetic construct
  source 1..20: mol_type = other DNA
tttgtgattataataaattt

SEQ ID NO: 1792 - DNA, 20 bp, synthetic construct
  source 1..20: mol_type = other DNA
attttgtgattataataaat

SEQ ID NO: 1793 - DNA, 20 bp, synthetic construct
  source 1..20: mol_type = other DNA
gaattttgtgattataataa

SEQ ID NO: 1794 - DNA, 20 bp, synthetic construct
  source 1..20: mol_type = other DNA
gtagaaatatcagacagcac

SEQ ID NO: 1795 - DNA, 20 bp, synthetic construct
  source 1..20: mol_type = other DNA
catagtagaaatatcagaca

SEQ ID NO: 1796 - DNA, 20 bp, synthetic construct
  source 1..20: mol_type = other DNA
aacatagtagaaatatcaga

SEQ ID NO: 1797 - DNA, 20 bp, synthetic construct
  source 1..20: mol_type = other DNA
actaagaaaacatagtagaa

SEQ ID NO: 1798 - DNA, 20 bp, synthetic construct
  source 1..20: mol_type = other DNA
ttttttataaacaccttgga

SEQ ID NO: 1799 - DNA, 20 bp, synthetic construct
  source 1..20: mol_type = other DNA
gtgaaattagtcaccttgga

SEQ ID NO: 1800 - DNA, 20 bp, synthetic construct
  source 1..20: mol_type = other DNA
aagctgtgaaattagtcacc

SEQ ID NO: 1801 - DNA, 20 bp, synthetic construct
  source 1..20: mol_type = other DNA
ataagctgtgaaattagtca

SEQ ID NO: 1802 - DNA, 20 bp, synthetic construct
  source 1..20: mol_type = other DNA
ttaaaggtttaaagacataa

SEQ ID NO: 1803 - DNA, 20 bp, synthetic construct
  source 1..20: mol_type = other DNA
aacataattttaattgcttc

SEQ ID NO: 1804 - DNA, 20 bp, synthetic construct
  source 1..20: mol_type = other DNA
agaacataattttaattgct

SEQ ID NO: 1805 - DNA, 20 bp, synthetic construct
  source 1..20: mol_type = other DNA
ataagcaaattgataaattt

SEQ ID NO: 1806 - DNA, 20 bp, synthetic construct
  source 1..20: mol_type = other DNA
caggtgaagatataagcaaa

SEQ ID NO: 1807 - DNA, 20 bp, synthetic construct
  source 1..20: mol_type = other DNA
cacaggtgaagatataagca

SEQ ID NO: 1808 - DNA, 20 bp, synthetic construct
  source 1..20: mol_type = other DNA
agcacaggtgaagatataag

SEQ ID NO: 1809 - DNA, 20 bp, synthetic construct
  source 1..20: mol_type = other DNA
cattcatctatttaaatagg

SEQ ID NO: 1810 - DNA, 20 bp, synthetic construct
  source 1..20: mol_type = other DNA
gaactgattatataagagag

SEQ ID NO: 1811 - DNA, 20 bp, synthetic construct
  source 1..20: mol_type = other DNA
ggaatattacaaaaaaaggg

SEQ ID NO: 1812 - DNA, 20 bp, synthetic construct
  source 1..20: mol_type = other DNA
agagacaatcctaaggaaaa

SEQ ID NO: 1813 - DNA, 20 bp, synthetic construct
  source 1..20: mol_type = other DNA
tagagacaatcctaaggaaa

SEQ ID NO: 1814 - DNA, 20 bp, synthetic construct
  source 1..20: mol_type = other DNA
cactagagacaatcctaagg

SEQ ID NO: 1815 - DNA, 20 bp, synthetic construct
  source 1..20: mol_type = other DNA
atggagaaaccccttccatc

SEQ ID NO: 1816 - DNA, 20 bp, synthetic construct
  source 1..20: mol_type = other DNA
ataccattactaaaagatgg

SEQ ID NO: 1817 - DNA, 20 bp, synthetic construct
  source 1..20: mol_type = other DNA
tccaaataccattactaaaa

SEQ ID NO: 1818 - DNA, 20 bp, synthetic construct
  source 1..20: mol_type = other DNA
ctccaaataccattactaaa

SEQ ID NO: 1819 - DNA, 20 bp, synthetic construct
  source 1..20: mol_type = other DNA
gatctccaaataccattact

SEQ ID NO: 1820 - DNA, 20 bp, synthetic construct
  source 1..20: mol_type = other DNA
gccagcactcaaattgtgat

SEQ ID NO: 1821 - DNA, 20 bp, synthetic construct
  source 1..20: mol_type = other DNA
cataacaaacccagcagcaa

SEQ ID NO: 1822 - DNA, 20 bp, synthetic construct
  source 1..20: mol_type = other DNA
taactacataacaaacccag

SEQ ID NO: 1823 - DNA, 20 bp, synthetic construct
  source 1..20: mol_type = other DNA
caataactacataacaaacc

SEQ ID NO: 1824 - DNA, 20 bp, synthetic construct
  source 1..20: mol_type = other DNA
acaataactacataacaaac

SEQ ID NO: 1825 - DNA, 20 bp, synthetic construct
  source 1..20: mol_type = other DNA
tcacaataactacataacaa

SEQ ID NO: 1826 - DNA, 20 bp, synthetic construct
  source 1..20: mol_type = other DNA
ttcacaataactacataaca

SEQ ID NO: 1827 - DNA, 20 bp, synthetic construct
  source 1..20: mol_type = other DNA
attcacaataactacataac

SEQ ID NO: 1828 - DNA, 20 bp, synthetic construct
  source 1..20: mol_type = other DNA
gtgaattcacaataactaca

SEQ ID NO: 1829 - DNA, 20 bp, synthetic construct
  source 1..20: mol_type = other DNA
tgtgaattcacaataactac

SEQ ID NO: 1830 - DNA, 20 bp, synthetic construct
  source 1..20: mol_type = other DNA
atgtgaattcacaataacta

SEQ ID NO: 1831 - DNA, 20 bp, synthetic construct
  source 1..20: mol_type = other DNA
ctatattcctaaatgtgaat

SEQ ID NO: 1832 - DNA, 20 bp, synthetic construct
  source 1..20: mol_type = other DNA
aaaccctatattcctaaatg

SEQ ID NO: 1833 - DNA, 20 bp, synthetic construct
  source 1..20: mol_type = other DNA
aattaaaaaccctatattcc

SEQ ID NO: 1834 - DNA, 20 bp, synthetic construct
  source 1..20: mol_type = other DNA
gaattaaaaaccctatattc

SEQ ID NO: 1835 - DNA, 20 bp, synthetic construct
  source 1..20: mol_type = other DNA
atctaaaatcaaagaattaa

SEQ ID NO: 1836 - DNA, 20 bp, synthetic construct
  source 1..20: mol_type = other DNA
tatctaaaatcaaagaatta

SEQ ID NO: 1837 - DNA, 20 bp, synthetic construct
  source 1..20: mol_type = other DNA
agtatctaaaatcaaagaat

SEQ ID NO: 1838 - DNA, 20 bp, synthetic construct
  source 1..20: mol_type = other DNA
acaagtatctaaaatcaaag

SEQ ID NO: 1839 - DNA, 20 bp, synthetic construct
  source 1..20: mol_type = other DNA
tacaagtatctaaaatcaaa

SEQ ID NO: 1840 - DNA, 20 bp, synthetic construct
  source 1..20: mol_type = other DNA
aaaaagatacaagtatctaa

SEQ ID NO: 1841 - DNA, 20 bp, synthetic construct
  source 1..20: mol_type = other DNA
agaaaaaagatacaagtatc

SEQ ID NO: 1842 - DNA, 20 bp, synthetic construct
  source 1..20: mol_type = other DNA
aggttttaaatataaaagaa

SEQ ID NO: 1843 - DNA, 20 bp, synthetic construct
  source 1..20: mol_type = other DNA
ccaaggttttaaatataaaa

SEQ ID NO: 1844 - DNA, 20 bp, synthetic construct
  source 1..20: mol_type = other DNA
gctgaaggccaaaggtagac

SEQ ID NO: 1845 - DNA, 20 bp, synthetic construct
  source 1..20: mol_type = other DNA
taggaaaaccacagcatggt

SEQ ID NO: 1846 - DNA, 20 bp, synthetic construct
  source 1..20: mol_type = other DNA
ttaggaaaaccacagcatgg

SEQ ID NO: 1847 - DNA, 20 bp, synthetic construct
  source 1..20: mol_type = other DNA
gttaggaaaaccacagcatg

SEQ ID NO: 1848 - DNA, 20 bp, synthetic construct
  source 1..20: mol_type = other DNA
acagatgatatttaagatcc

SEQ ID NO: 1849 - DNA, 20 bp, synthetic construct
  source 1..20: mol_type = other DNA
atagatcttatttacagatg

SEQ ID NO: 1850 - DNA, 20 bp, synthetic construct
  source 1..20: mol_type = other DNA
caagactaaagataaaagtt

SEQ ID NO: 1851 - DNA, 20 bp, synthetic construct
  source 1..20: mol_type = other DNA
tgtcaagactaaagataaaa

SEQ ID NO: 1852 - DNA, 20 bp, synthetic construct
  source 1..20: mol_type = other DNA
gatgtcaagactaaagataa

SEQ ID NO: 1853 - DNA, 20 bp, synthetic construct
  source 1..20: mol_type = other DNA
ggagttagtcaaagctaggt

SEQ ID NO: 1854 - DNA, 20 bp, synthetic construct
  source 1..20: mol_type = other DNA
taggagttagtcaaagctag

SEQ ID NO: 1855 - DNA, 20 bp, synthetic construct
  source 1..20: mol_type = other DNA
tggagatgccaaagctagga

SEQ ID NO: 1856 - DNA, 20 bp, synthetic construct
  source 1..20: mol_type = other DNA
tctttcatagacatgttcag

SEQ ID NO: 1857 - DNA, 20 bp, synthetic construct
  source 1..20: mol_type = other DNA
ataagtctttcatagacatg

SEQ ID NO: 1858 - DNA, 20 bp, synthetic construct
  source 1..20: mol_type = other DNA
aatggaaaacctgatggata

SEQ ID NO: 1859 - DNA, 20 bp, synthetic construct
  source 1..20: mol_type = other DNA
aagagtcacccttatggaaa

SEQ ID NO: 1860 - DNA, 20 bp, synthetic construct
  source 1..20: mol_type = other DNA
cggtataatatataggaacc

SEQ ID NO: 1861 - DNA, 20 bp, synthetic construct
  source 1..20: mol_type = other DNA
gtcggtataatatataggaa

SEQ ID NO: 1862 - DNA, 20 bp, synthetic construct
  source 1..20: mol_type = other DNA
ggttttattcaagacttcac

SEQ ID NO: 1863 - DNA, 20 bp, synthetic construct
  source 1..20: mol_type = other DNA
cttgggttttattcaagact

SEQ ID NO: 1864 - DNA, 20 bp, synthetic construct
  source 1..20: mol_type = other DNA
accatggtattctatgaaga

SEQ ID NO: 1865 - DNA, 20 bp, synthetic construct
  source 1..20: mol_type = other DNA
aataaatatgccagctcacc

SEQ ID NO: 1866 - DNA, 20 bp, synthetic construct
  source 1..20: mol_type = other DNA
tgtataataaatatgccagc

SEQ ID NO: 1867 - DNA, 20 bp, synthetic construct
  source 1..20: mol_type = other DNA
ttgtataataaatatgccag

SEQ ID NO: 1868 - DNA, 20 bp, synthetic construct
  source 1..20: mol_type = other DNA
gccagtaaaattgtttctgt

SEQ ID NO: 1869 - DNA, 20 bp, synthetic construct
  source 1..20: mol_type = other DNA
tgaacattttttatgaggac

SEQ ID NO: 1870 - DNA, 20 bp, synthetic construct
  source 1..20: mol_type = other DNA
ttgaacattttttatgagga

SEQ ID NO: 1871 - DNA, 20 bp, synthetic construct
  source 1..20: mol_type = other DNA
aatggaaaacctcaaaatag

SEQ ID NO: 1872 - DNA, 20 bp, synthetic construct
  source 1..20: mol_type = other DNA
atctaactgatttaagtttc

SEQ ID NO: 1873 - DNA, 20 bp, synthetic construct
  source 1..20: mol_type = other DNA
tacctaaaacaatctaactg

SEQ ID NO: 1874 - DNA, 20 bp, synthetic construct
  source 1..20: mol_type = other DNA
gctatacctaaaacaatcta

SEQ ID NO: 1875 - DNA, 20 bp, synthetic construct
  source 1..20: mol_type = other DNA
ggctatacctaaaacaatct

SEQ ID NO: 1876 - DNA, 20 bp, synthetic construct
  source 1..20: mol_type = other DNA
gggctatacctaaaacaatc

SEQ ID NO: 1877 - DNA, 20 bp, synthetic construct
  source 1..20: mol_type = other DNA
atgggctatacctaaaacaa

SEQ ID NO: 1878 - DNA, 20 bp, synthetic construct
  source 1..20: mol_type = other DNA
cacacaaaaaccaaggatgg

SEQ ID NO: 1879 - DNA, 20 bp, synthetic construct
  source 1..20: mol_type = other DNA
ccagggtttccccaagctag

SEQ ID NO: 1880 - DNA, 20 bp, synthetic construct
  source 1..20: mol_type = other DNA
ccagaaatccagggtttccc

SEQ ID NO: 1881 - DNA, 20 bp, synthetic construct
  source 1..20: mol_type = other DNA
ttccagaaatccagggtttc

SEQ ID NO: 1882 - DNA, 20 bp, synthetic construct
  source 1..20: mol_type = other DNA
atgattccagaaatccaggg

SEQ ID NO: 1883 - DNA, 20 bp, synthetic construct
  source 1..20: mol_type = other DNA
atatgattccagaaatccag

SEQ ID NO: 1884 - DNA, 20 bp, synthetic construct
  source 1..20: mol_type = other DNA
gtctaaatatgattccagaa

SEQ ID NO: 1885 - DNA, 20 bp, synthetic construct
  source 1..20: mol_type = other DNA
attacattagtctagtgtga

SEQ ID NO: 1886 - DNA, 20 bp, synthetic construct
  source 1..20: mol_type = other DNA
aaagaattacattagtctag

SEQ ID NO: 1887 - DNA, 20 bp, synthetic construct
  source 1..20: mol_type = other DNA
aaaagaattacattagtcta

SEQ ID NO: 1888 - DNA, 20 bp, synthetic construct
  source 1..20: mol_type = other DNA
cccaaaagaattacattagt

SEQ ID NO: 1889 - DNA, 20 bp, synthetic construct
  source 1..20: mol_type = other DNA
tcccaaaagaattacattag

SEQ ID NO: 1890 - DNA, 20 bp, synthetic construct
  source 1..20: mol_type = other DNA
atcccaaaagaattacatta

SEQ ID NO: 1891 - DNA, 20 bp, synthetic construct
  source 1..20: mol_type = other DNA
tttgcatcccaaaagaatta

SEQ ID NO: 1892 - DNA, 20 bp, synthetic construct
  source 1..20: mol_type = other DNA
aaaagctatttaaggtgtca

SEQ ID NO: 1893 - DNA, 20 bp, synthetic construct
  source 1..20: mol_type = other DNA
taaaagctatttaaggtgtc

SEQ ID NO: 1894 - DNA, 20 bp, synthetic construct
  source 1..20: mol_type = other DNA
ctaaaagctatttaaggtgt

SEQ ID NO: 1895 - DNA, 20 bp, synthetic construct
  source 1..20: mol_type = other DNA
ccaaatacctaaaagctatt

SEQ ID NO: 1896 - DNA, 20 bp, synthetic construct
  source 1..20: mol_type = other DNA
gccaaatacctaaaagctat

SEQ ID NO: 1897 - DNA, 20 bp, synthetic construct
  source 1..20: mol_type = other DNA
agccaaatacctaaaagcta

SEQ ID NO: 1898 - DNA, 20 bp, synthetic construct
  source 1..20: mol_type = other DNA
aagccaaatacctaaaagct

SEQ ID NO: 1899 - DNA, 20 bp, synthetic construct
  source 1..20: mol_type = other DNA
gaagccaaatacctaaaagc

SEQ ID NO: 1900 - DNA, 20 bp, synthetic construct
  source 1..20: mol_type = other DNA
ggaagccaaatacctaaaag

SEQ ID NO: 1901 - DNA, 20 bp, synthetic construct
  source 1..20: mol_type = other DNA
accccttgtaactaaaaata

SEQ ID NO: 1902 - DNA, 20 bp, synthetic construct
  source 1..20: mol_type = other DNA
tggctaaaactaatcatctg

SEQ ID NO: 1903 - DNA, 20 bp, synthetic construct
  source 1..20: mol_type = other DNA
atggctaaaactaatcatct

SEQ ID NO: 1904 - DNA, 20 bp, synthetic construct
  source 1..20: mol_type = other DNA
catggctaaaactaatcatc

SEQ ID NO: 1905 - DNA, 20 bp, synthetic construct
  source 1..20: mol_type = other DNA
cattacccttcatatataca

SEQ ID NO: 1906 - DNA, 20 bp, synthetic construct
  source 1..20: mol_type = other DNA
tccttaatacattacccttc

SEQ ID NO: 1907 - DNA, 20 bp, synthetic construct
  source 1..20: mol_type = other DNA
gtcgatactccttaatacat

SEQ ID NO: 1908 - DNA, 20 bp, synthetic construct
  source 1..20: mol_type = other DNA
ctacaaattattgtttctgg

SEQ ID NO: 1909 - DNA, 20 bp, synthetic construct
  source 1..20: mol_type = other DNA
ggctacaaattattgtttct

SEQ ID NO: 1910 - DNA, 20 bp, synthetic construct
  source 1..20: mol_type = other DNA
aggctacaaattattgtttc

SEQ ID NO: 1911 - DNA, 20 bp, synthetic construct
  source 1..20: mol_type = other DNA
aaggctacaaattattgttt

SEQ ID NO: 1912 - DNA, 20 bp, synthetic construct
  source 1..20: mol_type = other DNA
tgaaggctacaaattattgt

SEQ ID NO: 1913 - DNA, 20 bp, synthetic construct
  source 1..20: mol_type = other DNA
actgttaaacatatgatact

SEQ ID NO: 1914 - DNA, 20 bp, synthetic construct
  source 1..20: mol_type = other DNA
tcttggtttctactgttaaa

SEQ ID NO: 1915 - DNA, 20 bp, synthetic construct
  source 1..20: mol_type = other DNA
aaagggccctactaatatag

SEQ ID NO: 1916 - DNA, 20 bp, synthetic construct
  source 1..20: mol_type = other DNA
tgagaaataaatatgtctgt

SEQ ID NO: 1917 - DNA, 20 bp, synthetic construct
  source 1..20: mol_type = other DNA
cctcactttctccattgtaa

SEQ ID NO: 1918 - DNA, 20 bp, synthetic construct
  source 1..20: mol_type = other DNA
tcttatacttactagtaaag

SEQ ID NO: 1919 - DNA, 20 bp, synthetic construct
  source 1..20: mol_type = other DNA
gattcttatacttactagta

SEQ ID NO: 1920 - DNA, 20 bp, synthetic construct
  source 1..20: mol_type = other DNA
tgattcttatacttactagt

SEQ ID NO: 1921 - DNA, 20 bp, synthetic construct
  source 1..20: mol_type = other DNA
taatgattcttatacttact

SEQ ID NO: 1922 - DNA, 20 bp, synthetic construct
  source 1..20: mol_type = other DNA
ataatgattcttatacttac

SEQ ID NO: 1923 - DNA, 20 bp, synthetic construct
  source 1..20: mol_type = other DNA
tagtccaaataatgattctt

SEQ ID NO: 1924 - DNA, 20 bp, synthetic construct
  source 1..20: mol_type = other DNA
tggaaaaaaatacaagctga

SEQ ID NO: 1925 - DNA, 20 bp, synthetic construct
  source 1..20: mol_type = other DNA
ctggaaaaaaatacaagctg

SEQ ID NO: 1926 - DNA, 20 bp, synthetic construct
  source 1..20: mol_type = other DNA
actggaaaaaaatacaagct

SEQ ID NO: 1927 - DNA, 20 bp, synthetic construct
  source 1..20: mol_type = other DNA
cactggaaaaaaatacaagc

SEQ ID NO: 1928 - DNA, 20 bp, synthetic construct
  source 1..20: mol_type = other DNA
gattcaaaattgatgtaaaa

SEQ ID NO: 1929 - DNA, 20 bp, synthetic construct
  source 1..20: mol_type = other DNA
agattcaaaattgatgtaaa

SEQ ID NO: 1930 - DNA, 20 bp, synthetic construct
  source 1..20: mol_type = other DNA
aagagattcaaaattgatgt

SEQ ID NO: 1931 - DNA, 20 bp, synthetic construct
  source 1..20: mol_type = other DNA
aaagagattcaaaattgatg

SEQ ID NO: 1932 - DNA, 20 bp, synthetic construct
  source 1..20: mol_type = other DNA
aaaatcaacctaaccagtta

SEQ ID NO: 1933 - DNA, 20 bp, synthetic construct
  source 1..20: mol_type = other DNA
aaaaatcaacctaaccagtt

SEQ ID NO: 1934 - DNA, 20 bp, synthetic construct
  source 1..20: mol_type = other DNA
aaaggcaaaaatcaacctaa

SEQ ID NO: 1935 - DNA, 20 bp, synthetic construct
  source 1..20: mol_type = other DNA
atagaataacctaaaaaaaa

SEQ ID NO: 1936 - DNA, 20 bp, synthetic construct
  source 1..20: mol_type = other DNA
tatagaataacctaaaaaaa

SEQ ID NO: 1937 - DNA, 20 bp, synthetic construct
  source 1..20: mol_type = other DNA
aaatatagaataacctaaaa

SEQ ID NO: 1938 - DNA, 20 bp, synthetic construct
  source 1..20: mol_type = other DNA
acaaatatagaataacctaa

SEQ ID NO: 1939 - DNA, 20 bp, synthetic construct
  source 1..20: mol_type = other DNA
ggcctcatttttacctttgc

SEQ ID NO: 1940 - DNA, 20 bp, synthetic construct
  source 1..20: mol_type = other DNA
gaaatactaccatatattcc

SEQ ID NO: 1941 - DNA, 20 bp, synthetic construct
  source 1..20: mol_type = other DNA
agcatgaaaatttaattctc

SEQ ID NO: 1942 - DNA, 20 bp, synthetic construct
  source 1..20: mol_type = other DNA
ttcactaaaatataaggtcc

SEQ ID NO: 1943 - DNA, 20 bp, synthetic construct
  source 1..20: mol_type = other DNA
ctaataaacttcactaaaat

SEQ ID NO: 1944 - DNA, 20 bp, synthetic construct
  source 1..20: mol_type = other DNA
actaataaacttcactaaaa

SEQ ID NO: 1945 - DNA, 20 bp, synthetic construct
  source 1..20: mol_type = other DNA
attcaagtttaaactaataa

SEQ ID NO: 1946 - DNA, 20 bp, synthetic construct
  source 1..20: mol_type = other DNA
taagtatttcaaagagttga

SEQ ID NO: 1947 - DNA, 20 bp, synthetic construct
  source 1..20: mol_type = other DNA
tttaagtatttcaaagagtt

SEQ ID NO: 1948 - DNA, 20 bp, synthetic construct
  source 1..20: mol_type = other DNA
taatatatttaagtatttca

SEQ ID NO: 1949 - DNA, 20 bp, synthetic construct
  source 1..20: mol_type = other DNA
actaagttaatatatttaag

SEQ ID NO: 1950 - DNA, 20 bp, synthetic construct
  source 1..20: mol_type = other DNA
aggaatataccataccagct

SEQ ID NO: 1951 - DNA, 20 bp, synthetic construct
  source 1..20: mol_type = other DNA
ctaggaatataccataccag

SEQ ID NO: 1952 - DNA, 20 bp, synthetic construct
  source 1..20: mol_type = other DNA
ctagtaatataatgattgtg

SEQ ID NO: 1953 - DNA, 20 bp, synthetic construct
  source 1..20: mol_type = other DNA
gctctagtaatataatgatt

SEQ ID NO: 1954 - DNA, 20 bp, synthetic construct
  source 1..20: mol_type = other DNA
ttctggcaaataagctctag

SEQ ID NO: 1955 - DNA, 20 bp, synthetic construct
  source 1..20: mol_type = other DNA
ttagacataacataaaggca

SEQ ID NO: 1956 - DNA, 20 bp, synthetic construct
  source 1..20: mol_type = other DNA
aatcttctattttagacata

SEQ ID NO: 1957 - DNA, 20 bp, synthetic construct
  source 1..20: mol_type = other DNA
caaccaatcttctattttag

SEQ ID NO: 1958 - DNA, 20 bp, synthetic construct
  source 1..20: mol_type = other DNA
gcaaccaatcttctatttta

SEQ ID NO: 1959 - DNA, 20 bp, synthetic construct
  source 1..20: mol_type = other DNA
taactgcaaccaatcttcta

SEQ ID NO: 1960 - DNA, 20 bp, synthetic construct
  source 1..20: mol_type = other DNA
actctaaagaacaaaagcac

SEQ ID NO: 1961 - DNA, 20 bp, synthetic construct
  source 1..20: mol_type = other DNA
tatggactctaaagaacaaa

SEQ ID NO: 1962 - DNA, 20 bp, synthetic construct
  source 1..20: mol_type = other DNA
gtctttaccttgcatactta

SEQ ID NO: 1963 - DNA, 20 bp, synthetic construct
  source 1..20: mol_type = other DNA
tcagaatgtctttaccttgc

SEQ ID NO: 1964 - DNA, 20 bp, synthetic construct
  source 1..20: mol_type = other DNA
tgaatacaacacacatcaga

SEQ ID NO: 1965 - DNA, 20 bp, synthetic construct
  source 1..20: mol_type = other DNA
cagcaatgaatacaacacac

SEQ ID NO: 1966 - DNA, 20 bp, synthetic construct
  source 1..20: mol_type = other DNA
ttcagcaatgaatacaacac

SEQ ID NO: 1967 - DNA, 20 bp, synthetic construct
  source 1..20: mol_type = other DNA
aatcaattcttcagcaatga

SEQ ID NO: 1968 - DNA, 20 bp, synthetic construct
  source 1..20: mol_type = other DNA
gaatcaattcttcagcaatg

SEQ ID NO: 1969 - DNA, 20 bp, synthetic construct
  source 1..20: mol_type = other DNA
gaaatctaagaataattgga

SEQ ID NO: 1970 - DNA, 20 bp, synthetic construct
  source 1..20: mol_type = other DNA
tacattaacttccatgaaat

SEQ ID NO: 1971 - DNA, 20 bp, synthetic construct
  source 1..20: mol_type = other DNA
ctaagagtacattaacttcc

SEQ ID NO: 1972 - DNA, 20 bp, synthetic construct
  source 1..20: mol_type = other DNA
aattgtcaaaacacctctaa

SEQ ID NO: 1973 - DNA, 20 bp, synthetic construct
  source 1..20: mol_type = other DNA
aaagggaaagcccactatat

SEQ ID NO: 1974 - DNA, 20 bp, synthetic construct
  source 1..20: mol_type = other DNA
agtgatttccattataagaa

SEQ ID NO: 1975 - DNA, 20 bp, synthetic construct
  source 1..20: mol_type = other DNA
aagtgatttccattataaga

SEQ ID NO: 1976 - DNA, 20 bp, synthetic construct
  source 1..20: mol_type = other DNA
cctaataaaatataggttgt

SEQ ID NO: 1977 - DNA, 20 bp, synthetic construct
  source 1..20: mol_type = other DNA
tcctaataaaatataggttg

SEQ ID NO: 1978 - DNA, 20 bp, synthetic construct
  source 1..20: mol_type = other DNA
ctcctaataaaatataggtt

SEQ ID NO: 1979 - DNA, 20 bp, synthetic construct
  source 1..20: mol_type = other DNA
actcctaataaaatataggt

SEQ ID NO: 1980 - DNA, 20 bp, synthetic construct
  source 1..20: mol_type = other DNA
tataactactcctaataaaa

SEQ ID NO: 1981 - DNA, 20 bp, synthetic construct
  source 1..20: mol_type = other DNA
aaatataactactcctaata

SEQ ID NO: 1982 - DNA, 20 bp, synthetic construct
  source 1..20: mol_type = other DNA
aaaaatataactactcctaa

SEQ ID NO: 1983 - DNA, 20 bp, synthetic construct
  source 1..20: mol_type = other DNA
aggagtaaaaatataactac

SEQ ID NO: 1984 - DNA, 20 bp, synthetic construct
  source 1..20: mol_type = other DNA
caggagtaaaaatataacta

SEQ ID NO: 1985 - DNA, 20 bp, synthetic construct
  source 1..20: mol_type = other DNA
ccaggagtaaaaatataact

SEQ ID NO: 1986 - DNA, 20 bp, synthetic construct
  source 1..20: mol_type = other DNA
taaaataaccaggagtaaaa

SEQ ID NO: 1987 - DNA, 20 bp, synthetic construct
  source 1..20: mol_type = other DNA
ccaaataaaataaccaggag

SEQ ID NO: 1988 - DNA, 20 bp, synthetic construct
  source 1..20: mol_type = other DNA
aaccaaataaaataaccagg

SEQ ID NO: 1989 - DNA, 20 bp, synthetic construct
  source 1..20: mol_type = other DNA
tgttgaaaccaaataaaata

SEQ ID NO: 1990 - DNA, 20 bp, synthetic construct
  source 1..20: mol_type = other DNA
ccacaatttactattgtgtt

SEQ ID NO: 1991 - DNA, 20 bp, synthetic construct
  source 1..20: mol_type = other DNA
aaaaccacaatttactattg

SEQ ID NO: 1992 - DNA, 20 bp, synthetic construct
  source 1..20: mol_type = other DNA
aagattaaaaccacaattta

SEQ ID NO: 1993 - DNA, 20 bp, synthetic construct
  source 1..20: mol_type = other DNA
actgatacccacaaagatta

SEQ ID NO: 1994 - DNA, 20 bp, synthetic construct
  source 1..20: mol_type = other DNA
aagggtcaactgatacccac

SEQ ID NO: 1995 - DNA, 20 bp, synthetic construct
  source 1..20: mol_type = other DNA
atggcacatatttatgtaac

SEQ ID NO: 1996 - DNA, 20 bp, synthetic construct
  source 1..20: mol_type = other DNA
agttgcatagccaataaatg

SEQ ID NO: 1997 - DNA, 20 bp, synthetic construct
  source 1..20: mol_type = other DNA
tatcactaaaaaactgggcc

SEQ ID NO: 1998 - DNA, 20 bp, synthetic construct
  source 1..20: mol_type = other DNA
atatcactaaaaaactgggc

SEQ ID NO: 1999 - DNA, 20 bp, synthetic construct
  source 1..20: mol_type = other DNA
tatatcactaaaaaactggg

SEQ ID NO: 2000 - DNA, 20 bp, synthetic construct
  source 1..20: mol_type = other DNA
ttatatcactaaaaaactgg

SEQ ID NO: 2001 - DNA, 20 bp, synthetic construct
  source 1..20: mol_type = other DNA
gtttatatcactaaaaaact

SEQ ID NO: 2002 - DNA, 20 bp, synthetic construct
  source 1..20: mol_type = other DNA
agtttatatcactaaaaaac

SEQ ID NO: 2003 - DNA, 20 bp, synthetic construct
  source 1..20: mol_type = other DNA
tagtttatatcactaaaaaa

SEQ ID NO: 2004 - DNA, 20 bp, synthetic construct
  source 1..20: mol_type = other DNA
atagtttatatcactaaaaa

SEQ ID NO: 2005 - DNA, 20 bp, synthetic construct
  source 1..20: mol_type = other DNA
tgatagtttatatcactaaa

SEQ ID NO: 2006 - DNA, 20 bp, synthetic construct
  source 1..20: mol_type = other DNA
attgatagtttatatcacta

SEQ ID NO: 2007 - DNA, 20 bp, synthetic construct
  source 1..20: mol_type = other DNA
tgtcttaacatttttctttg

SEQ ID NO: 2008 - DNA, 20 bp, synthetic construct
  source 1..20: mol_type = other DNA
cacttcaaacttttaattaa

SEQ ID NO: 2009 - DNA, 20 bp, synthetic construct
  source 1..20: mol_type = other DNA
ccacttcaaacttttaatta

SEQ ID NO: 2010 - DNA, 20 bp, synthetic construct
  source 1..20: mol_type = other DNA
aacccacttcaaacttttaa

SEQ ID NO: 2011 - DNA, 20 bp, synthetic construct
  source 1..20: mol_type = other DNA
aaaacccacttcaaactttt

SEQ ID NO: 2012 - DNA, 20 bp, synthetic construct
  source 1..20: mol_type = other DNA
aagcaaatacatatgagtta

SEQ ID NO: 2013 - DNA, 20 bp, synthetic construct
  source 1..20: mol_type = other DNA
agaagcaaatacatatgagt

SEQ ID NO: 2014 - DNA, 20 bp, synthetic construct
  source 1..20: mol_type = other DNA
tagaagcaaatacatatgag

SEQ ID NO: 2015 - DNA, 20 bp, synthetic construct
  source 1..20: mol_type = other DNA
atttcattagaaagtagaag

SEQ ID NO: 2016 - DNA, 20 bp, synthetic construct
  source 1..20: mol_type = other DNA
aaataatttcattagaaagt

SEQ ID NO: 2017 - DNA, 20 bp, synthetic construct
  source 1..20: mol_type = other DNA
tgataaataatttcattaga

SEQ ID NO: 2018 - DNA, 20 bp, synthetic construct
  source 1..20: mol_type = other DNA
ttaatgaaatttcaatttta

SEQ ID NO: 2019 - DNA, 20 bp, synthetic construct
  source 1..20: mol_type = other DNA
taatcttcccattaatgaaa

SEQ ID NO: 2020 - DNA, 20 bp, synthetic construct
  source 1..20: mol_type = other DNA
aaaataatcttcccattaat

SEQ ID NO: 2021 - DNA, 20 bp, synthetic construct
  source 1..20: mol_type = other DNA
ggataaaaataatcttccca

SEQ ID NO: 2022 - DNA, 20 bp, synthetic construct
  source 1..20: mol_type = other DNA
aggataaaaataatcttccc

SEQ ID NO: 2023 - DNA, 20 bp, synthetic construct
  source 1..20: mol_type = other DNA
agaggcaagaaaagttcagg

SEQ ID NO: 2024 - DNA, 20 bp, synthetic construct
  source 1..20: mol_type = other DNA
gattgcacaccatatggagt

SEQ ID NO: 2025 - DNA, 20 bp, synthetic construct
  source 1..20: mol_type = other DNA
ctattaatcaaaaatgggat

SEQ ID NO: 2026 - DNA, 20 bp, synthetic construct
  source 1..20: mol_type = other DNA
tctattaatcaaaaatggga

SEQ ID NO: 2027 - DNA, 20 bp, synthetic construct
  source 1..20: mol_type = other DNA
actctattaatcaaaaatgg

SEQ ID NO: 2028 - DNA, 20 bp, synthetic construct
  source 1..20: mol_type = other DNA
aggactctattaatcaaaaa

SEQ ID NO: 2029 - DNA, 20 bp, synthetic construct
  source 1..20: mol_type = other DNA
gcaggactctattaatcaaa

SEQ ID NO: 2030 - DNA, 20 bp, synthetic construct
  source 1..20: mol_type = other DNA
ccctgctaatccagcaggac

SEQ ID NO: 2031 - DNA, 20 bp, synthetic construct
  source 1..20: mol_type = other DNA
aaagaaatctaaagctgatt

SEQ ID NO: 2032 - DNA, 20 bp, synthetic construct
  source 1..20: mol_type = other DNA
agaatattctactcttctgg

SEQ ID NO: 2033 - DNA, 20 bp, synthetic construct
  source 1..20: mol_type = other DNA
ttaagaatattctactcttc

SEQ ID NO: 2034 - DNA, 20 bp, synthetic construct
  source 1..20: mol_type = other DNA
ctctttaagaatattctact

SEQ ID NO: 2035 - DNA, 20 bp, synthetic construct
  source 1..20: mol_type = other DNA
tctctttaagaatattctac

SEQ ID NO: 2036 - DNA, 20 bp, synthetic construct
  source 1..20: mol_type = other DNA
ttcaagcaacaatatgtttg

SEQ ID NO: 2037 - DNA, 20 bp, synthetic construct
  source 1..20: mol_type = other DNA
tttaccaattcaagcaacaa

SEQ ID NO: 2038 - DNA, 20 bp, synthetic construct
  source 1..20: mol_type = other DNA
atttaccaattcaagcaaca

SEQ ID NO: 2039 - DNA, 20 bp, synthetic construct
  source 1..20: mol_type = other DNA
gtatttaccaattcaagcaa

SEQ ID NO: 2040 - DNA, 20 bp, synthetic construct
  source 1..20: mol_type = other DNA
actgtatttaccaattcaag

SEQ ID NO: 2041 - DNA, 20 bp, synthetic construct
  source 1..20: mol_type = other DNA
aaaccaatcactgtatttac

SEQ ID NO: 2042 - DNA, 20 bp, synthetic construct
  source 1..20: mol_type = other DNA
acaacaaaaaccaatcactg

SEQ ID NO: 2043 - DNA, 20 bp, synthetic construct
  source 1..20: mol_type = other DNA
cacaacaaaaaccaatcact

SEQ ID NO: 2044 - DNA, 20 bp, synthetic construct
  source 1..20: mol_type = other DNA
acctgaaaacaaaacacaac

SEQ ID NO: 2045 - DNA, 20 bp, synthetic construct
  source 1..20: mol_type = other DNA
tacctgaaaacaaaacacaa

SEQ ID NO: 2046 - DNA, 20 bp, synthetic construct
  source 1..20: mol_type = other DNA
aactacctgaaaacaaaaca

SEQ ID NO: 2047 - DNA, 20 bp, synthetic construct
  source 1..20: mol_type = other DNA
tttacttttcaaagtaggct

SEQ ID NO: 2048 - DNA, 20 bp, synthetic construct
  source 1..20: mol_type = other DNA
ctttacttttcaaagtaggc

SEQ ID NO: 2049 - DNA, 20 bp, synthetic construct
  source 1..20: mol_type = other DNA
tactttacttttcaaagtag

SEQ ID NO: 2050 - DNA, 20 bp, synthetic construct
  source 1..20: mol_type = other DNA
aactactttacttttcaaag

SEQ ID NO: 2051 - DNA, 20 bp, synthetic construct
  source 1..20: mol_type = other DNA
taccaactactttacttttc

SEQ ID NO: 2052 - DNA, 20 bp, synthetic construct
  source 1..20: mol_type = other DNA
ttgtaccaactactttactt

SEQ ID NO: 2053 - DNA, 20 bp, synthetic construct
  source 1..20: mol_type = other DNA
aacatgctactttaacttgt

SEQ ID NO: 2054 - DNA, 20 bp, synthetic construct
  source 1..20: mol_type = other DNA
agcaaatattaaacatgcta

SEQ ID NO: 2055 - DNA, 20 bp, synthetic construct
  source 1..20: mol_type = other DNA
caaaatagccaaagcaaata

SEQ ID NO: 2056 - DNA, 20 bp, synthetic construct
  source 1..20: mol_type = other DNA
gacaaaatagccaaagcaaa

SEQ ID NO: 2057 - DNA, 20 bp, synthetic construct
  source 1..20: mol_type = other DNA
ttacaaatagacaaaatagc

SEQ ID NO: 2058 - DNA, 20 bp, synthetic construct
  source 1..20: mol_type = other DNA
aaccatttacaaatagacaa

SEQ ID NO: 2059 - DNA, 20 bp, synthetic construct
  source 1..20: mol_type = other DNA
gcagtaaccatttacaaata

SEQ ID NO: 2060 - DNA, 20 bp, synthetic construct
  source 1..20: mol_type = other DNA
attcaaatattcacaggatt

SEQ ID NO: 2061 - DNA, 20 bp, synthetic construct
  source 1..20: mol_type = other DNA
aaatacattcaaatattcac

SEQ ID NO: 2062 - DNA, 20 bp, synthetic construct
  source 1..20: mol_type = other DNA
gccgtaaatttttattttta

SEQ ID NO: 2063 - DNA, 20 bp, synthetic construct
  source 1..20: mol_type = other DNA
tgccgtaaatttttattttt

SEQ ID NO: 2064 - DNA, 20 bp, synthetic construct
  source 1..20: mol_type = other DNA
gtttaaaaaatttatccagt

SEQ ID NO: 2065 - DNA, 20 bp, synthetic construct
  source 1..20: mol_type = other DNA
agtttaaaaaatttatccag

SEQ ID NO: 2066 - DNA, 20 bp, synthetic construct
  source 1..20: mol_type = other DNA
cagtttaaaaaatttatcca

SEQ ID NO: 2067 - DNA, 20 bp, synthetic construct
  source 1..20: mol_type = other DNA
cactcagtttaaaaaattta

SEQ ID NO: 2068 - DNA, 20 bp, synthetic construct
  source 1..20: mol_type = other DNA
ataaggtttccttcactcag

SEQ ID NO: 2069 - DNA, 20 bp, synthetic construct
  source 1..20: mol_type = other DNA
taaatgaaattttataaggt

SEQ ID NO: 2070 - DNA, 20 bp, synthetic construct
  source 1..20: mol_type = other DNA
gtcctaatttcatttttctt

SEQ ID NO: 2071 - DNA, 20 bp, synthetic construct
  source 1..20: mol_type = other DNA
ttgtcctaatttcatttttc

SEQ ID NO: 2072 - DNA, 20 bp, synthetic construct
  source 1..20: mol_type = other DNA
agggttaatcaggtaagcaa

SEQ ID NO: 2073 - DNA, 20 bp, synthetic construct
  source 1..20: mol_type = other DNA
gcagggttaatcaggtaagc

SEQ ID NO: 2074 - DNA, 20 bp, synthetic construct
  source 1..20: mol_type = other DNA
ttgatccagatttatggttt

SEQ ID NO: 2075 - DNA, 20 bp, synthetic construct
  source 1..20: mol_type = other DNA
aggagttgatccagatttat

SEQ ID NO: 2076 - DNA, 20 bp, synthetic construct
  source 1..20: mol_type = other DNA
aatgtattttcatatggtgg

SEQ ID NO: 2077 - DNA, 20 bp, synthetic construct
  source 1..20: mol_type = other DNA
aatgatagttacttgaaaag

SEQ ID NO: 2078 - DNA, 20 bp, synthetic construct
  source 1..20: mol_type = other DNA
tcttgtaatctttaacatga

SEQ ID NO: 2079 - DNA, 20 bp, synthetic construct
  source 1..20: mol_type = other DNA
ctgattatttatcttgtaat

SEQ ID NO: 2080 - DNA, 20 bp, synthetic construct
  source 1..20: mol_type = other DNA
tctgattatttatcttgtaa

SEQ ID NO: 2081 - DNA, 20 bp, synthetic construct
  source 1..20: mol_type = other DNA
gtctgattatttatcttgta

SEQ ID NO: 2082 - DNA, 20 bp, synthetic construct
  source 1..20: mol_type = other DNA
ggtctgattatttatcttgt

SEQ ID NO: 2083 - DNA, 20 bp, synthetic construct
  source 1..20: mol_type = other DNA
tggatgaaatacagcaaata

SEQ ID NO: 2084 - DNA, 20 bp, synthetic construct
  source 1..20: mol_type = other DNA
agaatggatgaaatacagca

SEQ ID NO: 2085 - DNA, 20 bp, synthetic construct
  source 1..20: mol_type = other DNA
aatgtgaaactatgtgcatc

SEQ ID NO: 2086 - DNA, 20 bp, synthetic construct
  source 1..20: mol_type = other DNA
gaaatgtgaaactatgtgca

SEQ ID NO: 2087 - DNA, 20 bp, synthetic construct
  source 1..20: mol_type = other DNA
ttgaaatgtgaaactatgtg

SEQ ID NO: 2088 - DNA, 20 bp, synthetic construct
  source 1..20: mol_type = other DNA
ttctcaatttcagagacatt

SEQ ID NO: 2089 - DNA, 20 bp, synthetic construct
  source 1..20: mol_type = other DNA
cttctcaatttcagagacat

SEQ ID NO: 2090 - DNA, 20 bp, synthetic construct
  source 1..20: mol_type = other DNA
gcttctcaatttcagagaca

SEQ ID NO: 2091 - DNA, 20 bp, synthetic construct
  source 1..20: mol_type = other DNA
gtgctgctaatatactgtca

SEQ ID NO: 2092 - DNA, 20 bp, synthetic construct
  source 1..20: mol_type = other DNA
gagccaatatttataggtgc

SEQ ID NO: 2093 - DNA, 20 bp, synthetic construct
  source 1..20: mol_type = other DNA
tgagccaatatttataggtg

SEQ ID NO: 2094 - DNA, 20 bp, synthetic construct
  source 1..20: mol_type = other DNA
ttataccatcaaatgtaaaa

SEQ ID NO: 2095 - DNA, 20 bp, synthetic construct
  source 1..20: mol_type = other DNA
cattataccatcaaatgtaa

SEQ ID NO: 2096 - DNA, 20 bp, synthetic construct
  source 1..20: mol_type = other DNA
ttcattataccatcaaatgt

SEQ ID NO: 2097 - DNA, 20 bp, synthetic construct
  source 1..20: mol_type = other DNA
cttcattataccatcaaatg

SEQ ID NO: 2098 - DNA, 20 bp, synthetic construct
  source 1..20: mol_type = other DNA
tcttcattataccatcaaat

SEQ ID NO: 2099 - DNA, 20 bp, synthetic construct
  source 1..20: mol_type = other DNA
ggtaaatattttcttcatta

SEQ ID NO: 2100 - DNA, 20 bp, synthetic construct
  source 1..20: mol_type = other DNA
aaaaaggtaaatattttctt

SEQ ID NO: 2101 - DNA, 20 bp, synthetic construct
  source 1..20: mol_type = other DNA
gttgtgacttaaaaacaaaa

SEQ ID NO: 2102 - DNA, 20 bp, synthetic construct
  source 1..20: mol_type = other DNA
tgagttgtgacttaaaaaca

SEQ ID NO: 2103 - DNA, 20 bp, synthetic construct
  source 1..20: mol_type = other DNA
cagaattttccttcatctac

SEQ ID NO: 2104 - DNA, 20 bp, synthetic construct
  source 1..20: mol_type = other DNA
tcagaattttccttcatcta

SEQ ID NO: 2105 - DNA, 20 bp, synthetic construct
  source 1..20: mol_type = other DNA
atcagaattttccttcatct

SEQ ID NO: 2106 - DNA, 20 bp, synthetic construct
  source 1..20: mol_type = other DNA
atctcacattaagaggatgt

SEQ ID NO: 2107 - DNA, 20 bp, synthetic construct
  source 1..20: mol_type = other DNA
atatctcacattaagaggat

SEQ ID NO: 2108 - DNA, 20 bp, synthetic construct
  source 1..20: mol_type = other DNA
aatatctcacattaagagga

SEQ ID NO: 2109 - DNA, 20 bp, synthetic construct
  source 1..20: mol_type = other DNA
ctagaaatatctcacattaa

SEQ ID NO: 2110 - DNA, 20 bp, synthetic construct
  source 1..20: mol_type = other DNA
aaagactagaaatatctcac

SEQ ID NO: 2111 - DNA, 20 bp, synthetic construct
  source 1..20: mol_type = other DNA
taaagactagaaatatctca

SEQ ID NO: 2112 - DNA, 20 bp, synthetic construct
  source 1..20: mol_type = other DNA
atctatactgaataaagact

SEQ ID NO: 2113 - DNA, 20 bp, synthetic construct
  source 1..20: mol_type = other DNA
cattaatctatactgaataa

SEQ ID NO: 2114 - DNA, 20 bp, synthetic construct
  source 1..20: mol_type = other DNA
ccattaatctatactgaata

SEQ ID NO: 2115 - DNA, 20 bp, synthetic construct
  source 1..20: mol_type = other DNA
gccattaatctatactgaat

SEQ ID NO: 2116 - DNA, 20 bp, synthetic construct
  source 1..20: mol_type = other DNA
agccattaatctatactgaa

SEQ ID NO: 2117 - DNA, 20 bp, synthetic construct
  source 1..20: mol_type = other DNA
tagccattaatctatactga

SEQ ID NO: 2118 - DNA, 20 bp, synthetic construct
  source 1..20: mol_type = other DNA
ttagccattaatctatactg

SEQ ID NO: 2119 - DNA, 20 bp, synthetic construct
  source 1..20: mol_type = other DNA
attagccattaatctatact

SEQ ID NO: 2120 - DNA, 20 bp, synthetic construct
  source 1..20: mol_type = other DNA
taattagccattaatctata

SEQ ID NO: 2121 - DNA, 20 bp, synthetic construct
  source 1..20: mol_type = other DNA
ataattagccattaatctat

SEQ ID NO: 2122 - DNA, 20 bp, synthetic construct
  source 1..20: mol_type = other DNA
atataattagccattaatct

SEQ ID NO: 2123 - DNA, 20 bp, synthetic construct
  source 1..20: mol_type = other DNA
aaatttaacatataattagc

SEQ ID NO: 2124 - DNA, 20 bp, synthetic construct
  source 1..20: mol_type = other DNA
tactttgaaatttaacatat

SEQ ID NO: 2125 - DNA, 20 bp, synthetic construct
  source 1..20: mol_type = other DNA
aaaaagcactaataagcact

SEQ ID NO: 2126 - DNA, 20 bp, synthetic construct
  source 1..20: mol_type = other DNA
ttaaaagtaaaaagcactaa

SEQ ID NO: 2127 - DNA, 20 bp, synthetic construct
  source 1..20: mol_type = other DNA
aagttaattttgaaacttaa

SEQ ID NO: 2128 - DNA, 20 bp, synthetic construct
  source 1..20: mol_type = other DNA
tttggagtttattataataa

SEQ ID NO: 2129 - DNA, 20 bp, synthetic construct
  source 1..20: mol_type = other DNA
tgctagtttttctacttttg

SEQ ID NO: 2130 - DNA, 20 bp, synthetic construct
  source 1..20: mol_type = other DNA
atgggagtattataaaacga

SEQ ID NO: 2131 - DNA, 20 bp, synthetic construct
  source 1..20: mol_type = other DNA
cagtggaaagaatgggagat

SEQ ID NO: 2132 - DNA, 20 bp, synthetic construct
  source 1..20: mol_type = other DNA
aaaataatccaaacttgcag

SEQ ID NO: 2133 - DNA, 20 bp, synthetic construct
  source 1..20: mol_type = other DNA
tacaaaataatccaaacttg

SEQ ID NO: 2134 - DNA, 20 bp, synthetic construct
  source 1..20: mol_type = other DNA
gttacaaaataatccaaact

SEQ ID NO: 2135 - DNA, 20 bp, synthetic construct
  source 1..20: mol_type = other DNA
tgttacaaaataatccaaac

SEQ ID NO: 2136 - DNA, 20 bp, synthetic construct
  source 1..20: mol_type = other DNA
ttgttacaaaataatccaaa

SEQ ID NO: 2137 - DNA, 20 bp, synthetic construct
  source 1..20: mol_type = other DNA
tatagaataatatgatgatt

SEQ ID NO: 2138 - DNA, 20 bp, synthetic construct
  source 1..20: mol_type = other DNA
gacacatattaaaatggtta

SEQ ID NO: 2139 - DNA, 20 bp, synthetic construct
  source 1..20: mol_type = other DNA
gcatttaactatgttaaaaa

SEQ ID NO: 2140 - DNA, 20 bp, synthetic construct
  source 1..20: mol_type = other DNA
agcatttaactatgttaaaa

SEQ ID NO: 2141 - DNA, 20 bp, synthetic construct
  source 1..20: mol_type = other DNA
atagcatttaactatgttaa

SEQ ID NO: 2142 - DNA, 20 bp, synthetic construct
  source 1..20: mol_type = other DNA
attttatgacaatagcattt

SEQ ID NO: 2143 - DNA, 20 bp, synthetic construct
  source 1..20: mol_type = other DNA
tgatatagaattacaattaa

SEQ ID NO: 2144 - DNA, 20 bp, synthetic construct
  source 1..20: mol_type = other DNA
aagtagatttaagttatttt

SEQ ID NO: 2145 - DNA, 20 bp, synthetic construct
  source 1..20: mol_type = other DNA
attaagtagatttaagttat

SEQ ID NO: 2146 - DNA, 20 bp, synthetic construct
  source 1..20: mol_type = other DNA
ttttctaattaagtagattt

SEQ ID NO: 2147 - DNA, 20 bp, synthetic construct
  source 1..20: mol_type = other DNA
gtttttctaattaagtagat

SEQ ID NO: 2148 - DNA, 20 bp, synthetic construct
  source 1..20: mol_type = other DNA
agtttttctaattaagtaga

SEQ ID NO: 2149 - DNA, 20 bp, synthetic construct
  source 1..20: mol_type = other DNA
ttagtttttctaattaagta

SEQ ID NO: 2150 - DNA, 20 bp, synthetic construct
  source 1..20: mol_type = other DNA
tgttagtttttctaattaag

SEQ ID NO: 2151 - DNA, 20 bp, synthetic construct
  source 1..20: mol_type = other DNA
tgctttaatttctatatttc

SEQ ID NO: 2152 - DNA, 20 bp, synthetic construct
  source 1..20: mol_type = other DNA
gccaaaatactaacatcagt

SEQ ID NO: 2153 - DNA, 20 bp, synthetic construct
  source 1..20: mol_type = other DNA
tgccaaaatactaacatcag

SEQ ID NO: 2154 - DNA, 20 bp, synthetic construct
  source 1..20: mol_type = other DNA
gtgccaaaatactaacatca

SEQ ID NO: 2155 - DNA, 20 bp, synthetic construct
  source 1..20: mol_type = other DNA
tgtgccaaaatactaacatc

SEQ ID NO: 2156 - DNA, 20 bp, synthetic construct
  source 1..20: mol_type = other DNA
atgtgccaaaatactaacat

SEQ ID NO: 2157 - DNA, 20 bp, synthetic construct
  source 1..20: mol_type = other DNA
gaatgtgccaaaatactaac

SEQ ID NO: 2158 - DNA, 20 bp, synthetic construct
  source 1..20: mol_type = other DNA
agaatgtgccaaaatactaa

SEQ ID NO: 2159 - DNA, 20 bp, synthetic construct
  source 1..20: mol_type = other DNA
acagaaaaagaatgtgccaa

SEQ ID NO: 2160 - DNA, 20 bp, synthetic construct
  source 1..20: mol_type = other DNA
gagtacaacacttacaaggt

SEQ ID NO: 2161 - DNA, 20 bp, synthetic construct
  source 1..20: mol_type = other DNA
agactatttactgtcatagg

SEQ ID NO: 2162 - DNA, 20 bp, synthetic construct
  source 1..20: mol_type = other DNA
aaagactatttactgtcata

SEQ ID NO: 2163 - DNA, 20 bp, synthetic construct
  source 1..20: mol_type = other DNA
acaaagactatttactgtca

SEQ ID NO: 2164 - DNA, 20 bp, synthetic construct
  source 1..20: mol_type = other DNA
agcctgttacaaagactatt

SEQ ID NO: 2165 - DNA, 20 bp, synthetic construct
  source 1..20: mol_type = other DNA
tatgaaatatcatgcagcct

SEQ ID NO: 2166 - DNA, 20 bp, synthetic construct
  source 1..20: mol_type = other DNA
ttatgaaatatcatgcagcc

SEQ ID NO: 2167 - DNA, 20 bp, synthetic construct
  source 1..20: mol_type = other DNA
cattcattttatgaaatatc

SEQ ID NO: 2168 - DNA, 20 bp, synthetic construct
  source 1..20: mol_type = other DNA
acatataaattatgccacat

SEQ ID NO: 2169 - DNA, 20 bp, synthetic construct
  source 1..20: mol_type = other DNA
agcagaattcaaaaggctca

SEQ ID NO: 2170 - DNA, 20 bp, synthetic construct
  source 1..20: mol_type = other DNA
gcaatataagaattgttcat

SEQ ID NO: 2171 - DNA, 20 bp, synthetic construct
  source 1..20: mol_type = other DNA
tcctttaacccaataatctg

SEQ ID NO: 2172 - DNA, 20 bp, synthetic construct
  source 1..20: mol_type = other DNA
gttcatatcctttaacccaa

SEQ ID NO: 2173 - DNA, 20 bp, synthetic construct
  source 1..20: mol_type = other DNA
agcaatttagaaatctgttc

SEQ ID NO: 2174 - DNA, 20 bp, synthetic construct
  source 1..20: mol_type = other DNA
atgggaattattctggaaag

SEQ ID NO: 2175 - DNA, 20 bp, synthetic construct
  source 1..20: mol_type = other DNA
tgaaagtatcacatgggaat

SEQ ID NO: 2176 - DNA, 20 bp, synthetic construct
  source 1..20: mol_type = other DNA
aaacatggtgaaagtatcac

SEQ ID NO: 2177 - DNA, 20 bp, synthetic construct
  source 1..20: mol_type = other DNA
gatgtatgtctttagaccat

SEQ ID NO: 2178 - DNA, 20 bp, synthetic construct
  source 1..20: mol_type = other DNA
gcagtttatttttatgcttt

SEQ ID NO: 2179 - DNA, 20 bp, synthetic construct
  source 1..20: mol_type = other DNA
gtttcatatttttaatccag

SEQ ID NO: 2180 - DNA, 20 bp, synthetic construct
  source 1..20: mol_type = other DNA
tggaagtttcatatttttaa

SEQ ID NO: 2181 - DNA, 20 bp, synthetic construct
  source 1..20: mol_type = other DNA
ttggaagtttcatattttta

SEQ ID NO: 2182 - DNA, 20 bp, synthetic construct
  source 1..20: mol_type = other DNA
acttacttagtcattattgg

SEQ ID NO: 2183 - DNA, 20 bp, synthetic construct
  source 1..20: mol_type = other DNA
ttataacttacttagtcatt

SEQ ID NO: 2184 - DNA, 20 bp, synthetic construct
  source 1..20: mol_type = other DNA
tgttataacttacttagtca

SEQ ID NO: 2185 - DNA, 20 bp, synthetic construct
  source 1..20: mol_type = other DNA
cttgttataacttacttagt

SEQ ID NO: 2186 - DNA, 20 bp, synthetic construct
  source 1..20: mol_type = other DNA
tgtttactaaaaagcactag

SEQ ID NO: 2187 - DNA, 20 bp, synthetic construct
  source 1..20: mol_type = other DNA
ctgtttactaaaaagcacta

SEQ ID NO: 2188 - DNA, 20 bp, synthetic construct
  source 1..20: mol_type = other DNA
cctgtttactaaaaagcact

SEQ ID NO: 2189 - DNA, 20 bp, synthetic construct
  source 1..20: mol_type = other DNA
accctgtttactaaaaagca

SEQ ID NO: 2190 - DNA, 20 bp, synthetic construct
  source 1..20: mol_type = other DNA
gaacatttttaaaagggtac

SEQ ID NO: 2191 - DNA, 20 bp, synthetic construct
  source 1..20: mol_type = other DNA
cgaacatttttaaaagggta

SEQ ID NO: 2192 - DNA, 20 bp, synthetic construct
  source 1..20: mol_type = other DNA
ttcgaacatttttaaaaggg

SEQ ID NO: 2193 - DNA, 20 bp, synthetic construct
  source 1..20: mol_type = other DNA
gaggtatatcgatattcgaa

SEQ ID NO: 2194 - DNA, 20 bp, synthetic construct
  source 1..20: mol_type = other DNA
atcctccaccaagtaggaag

SEQ ID NO: 2195 - DNA, 20 bp, synthetic construct
  source 1..20: mol_type = other DNA
ctcaatcaatcctccaccaa

SEQ ID NO: 2196 - DNA, 20 bp, synthetic construct
  source 1..20: mol_type = other DNA
gcacactttcctcctcaatc

SEQ ID NO: 2197 - DNA, 20 bp, synthetic construct
  source 1..20: mol_type = other DNA
gctggtaaccatcactgcac

SEQ ID NO: 2198 - DNA, 20 bp, synthetic construct
  source 1..20: mol_type = other DNA
agctggtaaccatcactgca

SEQ ID NO: 2199 - DNA, 20 bp, synthetic construct
  source 1..20: mol_type = other DNA
aagtcaagccaagaggctga

SEQ ID NO: 2200 - DNA, 20 bp, synthetic construct
  source 1..20: mol_type = other DNA
caaagtcaagccaagaggct

SEQ ID NO: 2201 - DNA, 20 bp, synthetic construct
  source 1..20: mol_type = other DNA
atttgcaaagtcaagccaag

SEQ ID NO: 2202 - DNA, 20 bp, synthetic construct
  source 1..20: mol_type = other DNA
aattctcaccagtatttgca

SEQ ID NO: 2203 - DNA, 20 bp, synthetic construct
  source 1..20: mol_type = other DNA
agctctttccaaattctcac

SEQ ID NO: 2204 - DNA, 20 bp, synthetic construct
  source 1..20: mol_type = other DNA
taagatattctcaagctctt

SEQ ID NO: 2205 - DNA, 20 bp, synthetic construct
  source 1..20: mol_type = other DNA
tgtaagatattctcaagctc

SEQ ID NO: 2206 - DNA, 20 bp, synthetic construct
  source 1..20: mol_type = other DNA
ctatgtaagatattctcaag

SEQ ID NO: 2207 - DNA, 20 bp, synthetic construct
  source 1..20: mol_type = other DNA
gactatgtaagatattctca

SEQ ID NO: 2208 - DNA, 20 bp, synthetic construct
  source 1..20: mol_type = other DNA
gcaacatgtgactatgtaag

SEQ ID NO: 2209 - DNA, 20 bp, synthetic construct
  source 1..20: mol_type = other DNA
tagttcttaactcttctcag

SEQ ID NO: 2210 - DNA, 20 bp, synthetic construct
  source 1..20: mol_type = other DNA
agttagttcttaactcttct

SEQ ID NO: 2211 - DNA, 20 bp, synthetic construct
  source 1..20: mol_type = other DNA
aatgaacatcaagaagttag

SEQ ID NO: 2212 - DNA, 20 bp, synthetic construct
  source 1..20: mol_type = other DNA
aattttagtgaaaggcaaat

SEQ ID NO: 2213 - DNA, 20 bp, synthetic construct
  source 1..20: mol_type = other DNA
aatcaggaattttagtgaaa

SEQ ID NO: 2214 - DNA, 20 bp, synthetic construct
  source 1..20: mol_type = other DNA
ctaagtaatcaggaatttta

SEQ ID NO: 2215 - DNA, 20 bp, synthetic construct
  source 1..20: mol_type = other DNA
aaagacagaacctagagaga

SEQ ID NO: 2216 - DNA, 20 bp, synthetic construct
  source 1..20: mol_type = other DNA
ccaagctcccaaagacagaa

SEQ ID NO: 2217 - DNA, 20 bp, synthetic construct
  source 1..20: mol_type = other DNA
gcttgataaccttagaccca

SEQ ID NO: 2218 - DNA, 20 bp, synthetic construct
  source 1..20: mol_type = other DNA
caaatactcaaaaagggaaa

SEQ ID NO: 2219 - DNA, 20 bp, synthetic construct
  source 1..20: mol_type = other DNA
tcaaatactcaaaaagggaa

SEQ ID NO: 2220 - DNA, 20 bp, synthetic construct
  source 1..20: mol_type = other DNA
cttcaaatactcaaaaaggg

SEQ ID NO: 2221 - DNA, 20 bp, synthetic construct
  source 1..20: mol_type = other DNA
gcttcaaatactcaaaaagg

SEQ ID NO: 2222 - DNA, 20 bp, synthetic construct
  source 1..20: mol_type = other DNA
agcttcaaatactcaaaaag

SEQ ID NO: 2223 - DNA, 20 bp, synthetic construct
  source 1..20: mol_type = other DNA
atgaagcttcaaatactcaa

SEQ ID NO: 2224 - DNA, 20 bp, synthetic construct
  source 1..20: mol_type = other DNA
tactatattcagtatgaagc

SEQ ID NO: 2225 - DNA, 20 bp, synthetic construct
  source 1..20: mol_type = other DNA
ttactatattcagtatgaag

SEQ ID NO: 2226 - DNA, 20 bp, synthetic construct
  source 1..20: mol_type = other DNA
gattactatattcagtatga

SEQ ID NO: 2227 - DNA, 20 bp, synthetic construct
  source 1..20: mol_type = other DNA
atgattactatattcagtat

SEQ ID NO: 2228 - DNA, 20 bp, synthetic construct
  source 1..20: mol_type = other DNA
ctatgattactatattcagt

SEQ ID NO: 2229 - DNA, 20 bp, synthetic construct
  source 1..20: mol_type = other DNA
actatgattactatattcag

SEQ ID NO: 2230 - DNA, 20 bp, synthetic construct
  source 1..20: mol_type = other DNA
tactatgattactatattca

SEQ ID NO: 2231 - DNA, 20 bp, synthetic construct
  source 1..20: mol_type = other DNA
gaatactatgattactatat

SEQ ID NO: 2232 - DNA, 20 bp, synthetic construct
  source 1..20: mol_type = other DNA
tgaatactatgattactata

SEQ ID NO: 2233 - DNA, 20 bp, synthetic construct
  source 1..20: mol_type = other DNA
gcatgaatactatgattact

SEQ ID NO: 2234 - DNA, 20 bp, synthetic construct
  source 1..20: mol_type = other DNA
tatgattttctttatgcatg

SEQ ID NO: 2235 - DNA, 20 bp, synthetic construct
  source 1..20: mol_type = other DNA
ttatgattttctttatgcat

SEQ ID NO: 2236 - DNA, 20 bp, synthetic construct
  source 1..20: mol_type = other DNA
gcaattactttatgattttc

SEQ ID NO: 2237 - DNA, 20 bp, synthetic construct
  source 1..20: mol_type = other DNA
atgcaattactttatgattt

SEQ ID NO: 2238 - DNA, 20 bp, synthetic construct
  source 1..20: mol_type = other DNA
tatgcaattactttatgatt

SEQ ID NO: 2239 - DNA, 20 bp, synthetic construct
  source 1..20: mol_type = other DNA
ttatgcaattactttatgat

SEQ ID NO: 2240 - DNA, 20 bp, synthetic construct
  source 1..20: mol_type = other DNA
tttatgcaattactttatga

SEQ ID NO: 2241 - DNA, 20 bp, synthetic construct
  source 1..20: mol_type = other DNA
atgattactttatgcattta

SEQ ID NO: 2242 - DNA, 20 bp, synthetic construct
  source 1..20: mol_type = other DNA
ctatgattactttatgcatt

SEQ ID NO: 2243 - DNA, 20 bp, synthetic construct
  source 1..20: mol_type = other DNA
gaaaactatgattactttat

SEQ ID NO: 2244 - DNA, 20 bp, synthetic construct
  source 1..20: mol_type = other DNA
tgaaaactatgattacttta

SEQ ID NO: 2245 - DNA, 20 bp, synthetic construct
  source 1..20: mol_type = other DNA
tgcatgaaaactatgattac

SEQ ID NO: 2246 - DNA, 20 bp, synthetic construct
  source 1..20: mol_type = other DNA
ctagtttttttaatgcatga

SEQ ID NO: 2247 - DNA, 20 bp, synthetic construct
  source 1..20: mol_type = other DNA
actagtttttttaatgcatg

SEQ ID NO: 2248 - DNA, 20 bp, synthetic construct
  source 1..20: mol_type = other DNA
aactagtttttttaatgcat

SEQ ID NO: 2249 - DNA, 20 bp, synthetic construct
  source 1..20: mol_type = other DNA
ataaattatgaatctgtaat

SEQ ID NO: 2250 - DNA, 20 bp, synthetic construct
  source 1..20: mol_type = other DNA
actcataaattatgaatctg

SEQ ID NO: 2251 - DNA, 20 bp, synthetic construct
  source 1..20: mol_type = other DNA
gactcataaattatgaatct

SEQ ID NO: 2252 - DNA, 20 bp, synthetic construct
  source 1..20: mol_type = other DNA
tgactcataaattatgaatc

SEQ ID NO: 2253 - DNA, 20 bp, synthetic construct
  source 1..20: mol_type = other DNA
ttaatgactcataaattatg

SEQ ID NO: 2254 - DNA, 20 bp, synthetic construct
  source 1..20: mol_type = other DNA
ggcttgaaaatattatttaa

SEQ ID NO: 2255 - DNA, 20 bp, synthetic construct
  source 1..20: mol_type = other DNA
gctggaaaaaatgtcatggc

SEQ ID NO: 2256 - DNA, 20 bp, synthetic construct
  source 1..20: mol_type = other DNA
tgctggaaaaaatgtcatgg

SEQ ID NO: 2257 - DNA, 20 bp, synthetic construct
  source 1..20: mol_type = other DNA
gtaaaacagatttagagact

SEQ ID NO: 2258 - DNA, 20 bp, synthetic construct
  source 1..20: mol_type = other DNA
tggtaaaacagatttagaga

SEQ ID NO: 2259 - DNA, 20 bp, synthetic construct
  source 1..20: mol_type = other DNA
ggttttacagtgacacagct

SEQ ID NO: 2260 - DNA, 20 bp, synthetic construct
  source 1..20: mol_type = other DNA
ttgcttaatttcatgcttct

SEQ ID NO: 2261 - DNA, 20 bp, synthetic construct
  source 1..20: mol_type = other DNA
aaatagtttcacacacattg

SEQ ID NO: 2262 - DNA, 20 bp, synthetic construct
  source 1..20: mol_type = other DNA
taaaatagtttcacacacat

SEQ ID NO: 2263 - DNA, 20 bp, synthetic construct
  source 1..20: mol_type = other DNA
tataaaatagtttcacacac

SEQ ID NO: 2264 - DNA, 20 bp, synthetic construct
  source 1..20: mol_type = other DNA
aactgccaacatgtatgtat

SEQ ID NO: 2265 - DNA, 20 bp, synthetic construct
  source 1..20: mol_type = other DNA
catttcaaagccacacctag

SEQ ID NO: 2266 - DNA, 20 bp, synthetic construct
  source 1..20: mol_type = other DNA
catccatttcaaagccacac

SEQ ID NO: 2267 - DNA, 20 bp, synthetic construct
  source 1..20: mol_type = other DNA
tgtccatgaagatatttgtg

SEQ ID NO: 2268 - DNA, 20 bp, synthetic construct
  source 1..20: mol_type = other DNA
atagcaatccatgtccatga

SEQ ID NO: 2269 - DNA, 20 bp, synthetic construct
  source 1..20: mol_type = other DNA
catagcaatccatgtccatg

SEQ ID NO: 2270 - DNA, 20 bp, synthetic construct
  source 1..20: mol_type = other DNA
tcatagcaatccatgtccat

SEQ ID NO: 2271 - DNA, 20 bp, synthetic construct
  source 1..20: mol_type = other DNA
ttaggcaatcaaacactcat

SEQ ID NO: 2272 - DNA, 20 bp, synthetic construct
  source 1..20: mol_type = other DNA
taaattataccatatcactg

SEQ ID NO: 2273 - DNA, 20 bp, synthetic construct
  source 1..20: mol_type = other DNA
tgataaattataccatatca

SEQ ID NO: 2274 - DNA, 20 bp, synthetic construct
  source 1..20: mol_type = other DNA
tgtttgataaattataccat

SEQ ID NO: 2275 - DNA, 20 bp, synthetic construct
  source 1..20: mol_type = other DNA
tttctgtttctcaacactgt

SEQ ID NO: 2276 - DNA, 20 bp, synthetic construct
  source 1..20: mol_type = other DNA
ctctttaaaacatccccagt

SEQ ID NO: 2277 - DNA, 20 bp, synthetic construct
  source 1..20: mol_type = other DNA
tttcctctttaaaacatccc

SEQ ID NO: 2278 - DNA, 20 bp, synthetic construct
  source 1..20: mol_type = other DNA
tatgtaaacccctaatttct

SEQ ID NO: 2279 - DNA, 20 bp, synthetic construct
  source 1..20: mol_type = other DNA
tttcttaagattatgtaaac

SEQ ID NO: 2280 - DNA, 20 bp, synthetic construct
  source 1..20: mol_type = other DNA
tttaatatcctcattaccca

SEQ ID NO: 2281 - DNA, 20 bp, synthetic construct
  source 1..20: mol_type = other DNA
atttaatatcctcattaccc

SEQ ID NO: 2282 - DNA, 20 bp, synthetic construct
  source 1..20: mol_type = other DNA
aatttaatatcctcattacc

SEQ ID NO: 2283 - DNA, 20 bp, synthetic construct
  source 1..20: mol_type = other DNA
cttaaatttaatatcctcat

SEQ ID NO: 2284 - DNA, 20 bp, synthetic construct
  source 1..20: mol_type = other DNA
ttcttaaatttaatatcctc

SEQ ID NO: 2285 - DNA, 20 bp, synthetic construct
  source 1..20: mol_type = other DNA
tgttcttaaatttaatatcc

SEQ ID NO: 2286 - DNA, 20 bp, synthetic construct
  source 1..20: mol_type = other DNA
gctttctatgccaaggatca

SEQ ID NO: 2287 - DNA, 20 bp, synthetic construct
  source 1..20: mol_type = other DNA
agtcccaaaattctgcttca

SEQ ID NO: 2288 - DNA, 20 bp, synthetic construct
  source 1..20: mol_type = other DNA
tgccagtcccaaaattctgc

SEQ ID NO: 2289 - DNA, 20 bp, synthetic construct
  source 1..20: mol_type = other DNA
gcaagcaaagccatttggga

SEQ ID NO: 2290 - DNA, 20 bp, synthetic construct
  source 1..20: mol_type = other DNA
ctaaaaatacaaaccttgtc

SEQ ID NO: 2291 - DNA, 20 bp, synthetic construct
  source 1..20: mol_type = other DNA
catgagctttaaaaagcaga

SEQ ID NO: 2292 - DNA, 20 bp, synthetic construct
  source 1..20: mol_type = other DNA
tggttacaaattaagtgctc

SEQ ID NO: 2293 - DNA, 20 bp, synthetic construct
  source 1..20: mol_type = other DNA
ctggttacaaattaagtgct

SEQ ID NO: 2294 - DNA, 20 bp, synthetic construct
  source 1..20: mol_type = other DNA
ttctggttacaaattaagtg

SEQ ID NO: 2295 - DNA, 20 bp, synthetic construct
  source 1..20: mol_type = other DNA
attattttacaagtaggatt

SEQ ID NO: 2296 - DNA, 20 bp, synthetic construct
  source 1..20: mol_type = other DNA
tagattattttacaagtagg

SEQ ID NO: 2297 - DNA, 20 bp, synthetic construct
  source 1..20: mol_type = other DNA
ttagattattttacaagtag

SEQ ID NO: 2298 - DNA, 20 bp, synthetic construct
  source 1..20: mol_type = other DNA
cttagattattttacaagta

SEQ ID NO: 2299 - DNA, 20 bp, synthetic construct
  source 1..20: mol_type = other DNA
catgtcttagattattttac

SEQ ID NO: 2300 - DNA, 20 bp, synthetic construct
  source 1..20: mol_type = other DNA
tagaggttacaaagctaaaa

SEQ ID NO: 2301 - DNA, 20 bp, synthetic construct
  source 1..20: mol_type = other DNA
ccatcaatattatagaggtt

SEQ ID NO: 2302 - DNA, 20 bp, synthetic construct
  source 1..20: mol_type = other DNA
tccagctgtgaagacactga

SEQ ID NO: 2303 - DNA, 20 bp, synthetic construct
  source 1..20: mol_type = other DNA
accttgaaacaatgtagaca

SEQ ID NO: 2304 - DNA, 20 bp, synthetic construct
  source 1..20: mol_type = other DNA
acttttagtttatgaaaaat

SEQ ID NO: 2305 - DNA, 20 bp, synthetic construct
  source 1..20: mol_type = other DNA
ctacttttagtttatgaaaa

SEQ ID NO: 2306 - DNA, 20 bp, synthetic construct
  source 1..20: mol_type = other DNA
ttattctacttttagtttat

SEQ ID NO: 2307 - DNA, 20 bp, synthetic construct
  source 1..20: mol_type = other DNA
cctttattctacttttagtt

SEQ ID NO: 2308 - DNA, 20 bp, synthetic construct
  source 1..20: mol_type = other DNA
gcctttattctacttttagt

SEQ ID NO: 2309 - DNA, 20 bp, synthetic construct
  source 1..20: mol_type = other DNA
atagcctttattctactttt

SEQ ID NO: 2310 - DNA, 20 bp, synthetic construct
  source 1..20: mol_type = other DNA
aggaatagcctttattctac

SEQ ID NO: 2311 - DNA, 20 bp, synthetic construct
  source 1..20: mol_type = other DNA
agaggaatagcctttattct

SEQ ID NO: 2312 - DNA, 20 bp, synthetic construct
  source 1..20: mol_type = other DNA
agatagcaattttagaggaa

SEQ ID NO: 2313 - DNA, 20 bp, synthetic construct
  source 1..20: mol_type = other DNA
cccattagcaaatcctgatg

SEQ ID NO: 2314 - DNA, 20 bp, synthetic construct
  source 1..20: mol_type = other DNA
agaaagttcaactaatgaga

SEQ ID NO: 2315 - DNA, 20 bp, synthetic construct
  source 1..20: mol_type = other DNA
ttttgtgttttaaaactgtg

SEQ ID NO: 2316 - DNA, 20 bp, synthetic construct
  source 1..20: mol_type = other DNA
tggcacattttttatagagt

SEQ ID NO: 2317 - DNA, 20 bp, synthetic construct
  source 1..20: mol_type = other DNA
caacaattattaatagaatg

SEQ ID NO: 2318 - DNA, 20 bp, synthetic construct
  source 1..20: mol_type = other DNA
gcaacaattattaatagaat

SEQ ID NO: 2319 - DNA, 20 bp, synthetic construct
  source 1..20: mol_type = other DNA
agcaacaattattaatagaa

SEQ ID NO: 2320 - DNA, 20 bp, synthetic construct
  source 1..20: mol_type = other DNA
cagcaacaattattaataga

SEQ ID NO: 2321 - DNA, 20 bp, synthetic construct
  source 1..20: mol_type = other DNA
accagcaacaattattaata

SEQ ID NO: 2322 - DNA, 20 bp, synthetic construct
  source 1..20: mol_type = other DNA
taccagcaacaattattaat

SEQ ID NO: 2323 - DNA, 20 bp, synthetic construct
  source 1..20: mol_type = other DNA
ttttaaattaccagcaacaa

SEQ ID NO: 2324 - DNA, 20 bp, synthetic construct
  source 1..20: mol_type = other DNA
atttttaaattaccagcaac

SEQ ID NO: 2325 - DNA, 20 bp, synthetic construct
  source 1..20: mol_type = other DNA
aaggatttttaaattaccag

SEQ ID NO: 2326 - DNA, 20 bp, synthetic construct
  source 1..20: mol_type = other DNA
aacaaggatttttaaattac

SEQ ID NO: 2327 - DNA, 20 bp, synthetic construct
  source 1..20: mol_type = other DNA
gctgacaatctcagtgagaa

SEQ ID NO: 2328 - DNA, 20 bp, synthetic construct
  source 1..20: mol_type = other DNA
aacagctgacaatctcagtg

SEQ ID NO: 2329 - DNA, 20 bp, synthetic construct
  source 1..20: mol_type = other DNA
aaacttacaaacagctgaca

SEQ ID NO: 2330 - DNA, 20 bp, synthetic construct
  source 1..20: mol_type = other DNA
caaaacttacaaacagctga

SEQ ID NO: 2331 - DNA, 20 bp, synthetic construct
  source 1..20: mol_type = other DNA
accaaaaaccaaaacttaca

SEQ ID NO: 2332 - DNA, 20 bp, synthetic construct
  source 1..20: mol_type = other DNA
aaccaaaaaccaaaacttac

SEQ ID NO: 2333 - DNA, 20 bp, synthetic construct
  source 1..20: mol_type = other DNA
ctaaaaaaccccaaatctaa

SEQ ID NO: 2334 - DNA, 20 bp, synthetic construct
  source 1..20: mol_type = other DNA
cctaaaaaaccccaaatcta

SEQ ID NO: 2335 - DNA, 20 bp, synthetic construct
  source 1..20: mol_type = other DNA
tcctaaaaaaccccaaatct

SEQ ID NO: 2336 - DNA, 20 bp, synthetic construct
  source 1..20: mol_type = other DNA
attcacaaatcctaaaaaac

SEQ ID NO: 2337 - DNA, 20 bp, synthetic construct
  source 1..20: mol_type = other DNA
gcaaatattcacaaatccta

SEQ ID NO: 2338 - DNA, 20 bp, synthetic construct
  source 1..20: mol_type = other DNA
gtgcaaatattcacaaatcc

SEQ ID NO: 2339 - DNA, 20 bp, synthetic construct
  source 1..20: mol_type = other DNA
agtgcaaatattcacaaatc

SEQ ID NO: 2340 - DNA, 20 bp, synthetic construct
  source 1..20: mol_type = other DNA
atagtgcaaatattcacaaa

SEQ ID NO: 2341 - DNA, 20 bp, synthetic construct
  source 1..20: mol_type = other DNA
catgatactcaaaagaggtg

SEQ ID NO: 2342 - DNA, 20 bp, synthetic construct
  source 1..20: mol_type = other DNA
catcctaaatccgagaatca

SEQ ID NO: 2343 - DNA, 20 bp, synthetic construct
  source 1..20: mol_type = other DNA
caagcatcctaaatccgaga

SEQ ID NO: 2344 - DNA, 20 bp, synthetic construct
  source 1..20: mol_type = other DNA
aatctgaaattacaggtcaa

SEQ ID NO: 2345 - DNA, 20 bp, synthetic construct
  source 1..20: mol_type = other DNA
taaatctgaaattacaggtc

SEQ ID NO: 2346 - DNA, 20 bp, synthetic construct
  source 1..20: mol_type = other DNA
ttctgcttttatgtaaatct

SEQ ID NO: 2347 - DNA, 20 bp, synthetic construct
  source 1..20: mol_type = other DNA
catattattcccaaatggtt

SEQ ID NO: 2348 - DNA, 20 bp, synthetic construct
  source 1..20: mol_type = other DNA
acttagaaaatatacactga

SEQ ID NO: 2349 - DNA, 20 bp, synthetic construct
  source 1..20: mol_type = other DNA
gtacttagaaaatatacact

SEQ ID NO: 2350 - DNA, 20 bp, synthetic construct
  source 1..20: mol_type = other DNA
taggaatatattcttgtact

SEQ ID NO: 2351 - DNA, 20 bp, synthetic construct
  source 1..20: mol_type = other DNA
tatgtaggaatatattcttg

SEQ ID NO: 2352 - DNA, 20 bp, synthetic construct
  source 1..20: mol_type = other DNA
taaaatgtttaaacatgacg

SEQ ID NO: 2353 - DNA, 20 bp, synthetic construct
  source 1..20: mol_type = other DNA
tccccattttaaaatgttta

SEQ ID NO: 2354 - DNA, 20 bp, synthetic construct
  source 1..20: mol_type = other DNA
taatacaaatccccatttta

SEQ ID NO: 2355 - DNA, 20 bp, synthetic construct
  source 1..20: mol_type = other DNA
aatgtaatacaaatccccat

SEQ ID NO: 2356 - DNA, 20 bp, synthetic construct
  source 1..20: mol_type = other DNA
atcagattttaagtaatact

SEQ ID NO: 2357 - DNA, 20 bp, synthetic construct
  source 1..20: mol_type = other DNA
attatcagattttaagtaat

SEQ ID NO: 2358 - DNA, 20 bp, synthetic construct
  source 1..20: mol_type = other DNA
cacattatcagattttaagt

SEQ ID NO: 2359 - DNA, 20 bp, synthetic construct
  source 1..20: mol_type = other DNA
acacattatcagattttaag

SEQ ID NO: 2360 - DNA, 20 bp, synthetic construct
  source 1..20: mol_type = other DNA
cacacattatcagattttaa

SEQ ID NO: 2361 - DNA, 20 bp, synthetic construct
  source 1..20: mol_type = other DNA
tttaacacacattatcagat

SEQ ID NO: 2362 - DNA, 20 bp, synthetic construct
  source 1..20: mol_type = other DNA
actatttaacacacattatc

SEQ ID NO: 2363 - DNA, 20 bp, synthetic construct
  source 1..20: mol_type = other DNA
ctactatttaacacacatta

SEQ ID NO: 2364 - DNA, 20 bp, synthetic construct
  source 1..20: mol_type = other DNA
aaactactatttaacacaca

SEQ ID NO: 2365 - DNA, 20 bp, synthetic construct
  source 1..20: mol_type = other DNA
aaaactactatttaacacac

SEQ ID NO: 2366 - DNA, 20 bp, synthetic construct
  source 1..20: mol_type = other DNA
aatgaaaactactatttaac

SEQ ID NO: 2367 - DNA, 20 bp, synthetic construct
  source 1..20: mol_type = other DNA
tatcttactcatctatttcc

SEQ ID NO: 2368 - DNA, 20 bp, synthetic construct
  source 1..20: mol_type = other DNA
tatttccctctttatggcat

SEQ ID NO: 2369 - DNA, 20 bp, synthetic construct
  source 1..20: mol_type = other DNA
cccattatttcatcacttca

SEQ ID NO: 2370 - DNA, 20 bp, synthetic construct
  source 1..20: mol_type = other DNA
tgacattcccattatttcat

SEQ ID NO: 2371 - DNA, 20 bp, synthetic construct
  source 1..20: mol_type = other DNA
ccatcccaccaaaagtagcc

SEQ ID NO: 2372 - DNA, 20 bp, synthetic construct
  source 1..20: mol_type = other DNA
agcttaaaatttatctcccc

SEQ ID NO: 2373 - DNA, 20 bp, synthetic construct
  source 1..20: mol_type = other DNA
gagcttaaaatttatctccc

SEQ ID NO: 2374 - DNA, 20 bp, synthetic construct
  source 1..20: mol_type = other DNA
ataatgtttccatggctggc

SEQ ID NO: 2375 - DNA, 20 bp, synthetic construct
  source 1..20: mol_type = other DNA
tgagttaacataatgtttcc

SEQ ID NO: 2376 - DNA, 20 bp, synthetic construct
  source 1..20: mol_type = other DNA
tgtgagttaacataatgttt

SEQ ID NO: 2377 - DNA, 20 bp, synthetic construct
  source 1..20: mol_type = other DNA
tcaaactaccatgtgagtta

SEQ ID NO: 2378 - DNA, 20 bp, synthetic construct
  source 1..20: mol_type = other DNA
catttcaaactaccatgtga

SEQ ID NO: 2379 - DNA, 20 bp, synthetic construct
  source 1..20: mol_type = other DNA
gcatttcaaactaccatgtg

SEQ ID NO: 2380 - DNA, 20 bp, synthetic construct
  source 1..20: mol_type = other DNA
aaagcatttcaaactaccat

SEQ ID NO: 2381 - DNA, 20 bp, synthetic construct
  source 1..20: mol_type = other DNA
agtcaccaaaaataagtacc

SEQ ID NO: 2382 - DNA, 20 bp, synthetic construct
  source 1..20: mol_type = other DNA
ttgttgaaagtcaccaaaaa

SEQ ID NO: 2383 - DNA, 20 bp, synthetic construct
  source 1..20: mol_type = other DNA
acccttaatattgttgaaag

SEQ ID NO: 2384 - DNA, 20 bp, synthetic construct
  source 1..20: mol_type = other DNA
agacccttaatattgttgaa

SEQ ID NO: 2385 - DNA, 20 bp, synthetic construct
  source 1..20: mol_type = other DNA
tttatagacccttaatattg

SEQ ID NO: 2386 - DNA, 20 bp, synthetic construct
  source 1..20: mol_type = other DNA
tacaaaaagattcactggta

SEQ ID NO: 2387 - DNA, 20 bp, synthetic construct
  source 1..20: mol_type = other DNA
catacaaaaagattcactgg

SEQ ID NO: 2388 - DNA, 20 bp, synthetic construct
  source 1..20: mol_type = other DNA
tatcatacaaaaagattcac

SEQ ID NO: 2389 - DNA, 20 bp, synthetic construct
  source 1..20: mol_type = other DNA
cctatcatacaaaaagattc

SEQ ID NO: 2390 - DNA, 20 bp, synthetic construct
  source 1..20: mol_type = other DNA
aaaacctatcatacaaaaag

SEQ ID NO: 2391 - DNA, 20 bp, synthetic construct
  source 1..20: mol_type = other DNA
aaacaaaaaacctatcatac

SEQ ID NO: 2392 - DNA, 20 bp, synthetic construct
  source 1..20: mol_type = other DNA
aataacctatcatggccagg

SEQ ID NO: 2393 - DNA, 20 bp, synthetic construct
  source 1..20: mol_type = other DNA
cacaaaataacctatcatgg

SEQ ID NO: 2394 - DNA, 20 bp, synthetic construct
  source 1..20: mol_type = other DNA
tcacaaaataacctatcatg

SEQ ID NO: 2395 - DNA, 20 bp, synthetic construct
  source 1..20: mol_type = other DNA
catcacaaaataacctatca

SEQ ID NO: 2396 - DNA, 20 bp, synthetic construct
  source 1..20: mol_type = other DNA
tcatcacaaaataacctatc

SEQ ID NO: 2397 - DNA, 20 bp, synthetic construct
  source 1..20: mol_type = other DNA
ttcatcacaaaataacctat

SEQ ID NO: 2398 - DNA, 20 bp, synthetic construct
  source 1..20: mol_type = other DNA
tttcatcacaaaataaccta

SEQ ID NO: 2399 - DNA, 20 bp, synthetic construct
  source 1..20: mol_type = other DNA
cagacaaattaagaggtagg

SEQ ID NO: 2400 - DNA, 20 bp, synthetic construct
  source 1..20: mol_type = other DNA
atcagacaaattaagaggta

SEQ ID NO: 2401 - DNA, 20 bp, synthetic construct
  source 1..20: mol_type = other DNA
tatcagacaaattaagaggt

SEQ ID NO: 2402 - DNA, 20 bp, synthetic construct
  source 1..20: mol_type = other DNA
taaatttatcagacaaatta

SEQ ID NO: 2403 - DNA, 20 bp, synthetic construct
  source 1..20: mol_type = other DNA
tttaaatttatcagacaaat

SEQ ID NO: 2404 - DNA, 20 bp, synthetic construct
  source 1..20: mol_type = other DNA
atttaaatttatcagacaaa

SEQ ID NO: 2405 - DNA, 20 bp, synthetic construct
  source 1..20: mol_type = other DNA
aaaatttaaatttatcagac

SEQ ID NO: 2406 - DNA, 20 bp, synthetic construct
  source 1..20: mol_type = other DNA
ataaaatttaaatttatcag

SEQ ID NO: 2407 - DNA, 20 bp, synthetic construct
  source 1..20: mol_type = other DNA
agacataaaatttaaattta

SEQ ID NO: 2408 - DNA, 20 bp, synthetic construct
  source 1..20: mol_type = other DNA
ctagacataaaatttaaatt

SEQ ID NO: 2409 - DNA, 20 bp, synthetic construct
  source 1..20: mol_type = other DNA
tactttaaaatatggaagtg

SEQ ID NO: 2410 - DNA, 20 bp, synthetic construct
  source 1..20: mol_type = other DNA
agattactttaaaatatgga

SEQ ID NO: 2411 - DNA, 20 bp, synthetic construct
  source 1..20: mol_type = other DNA
tctgatacagattactttaa

SEQ ID NO: 2412 - DNA, 20 bp, synthetic construct
  source 1..20: mol_type = other DNA
agtctgatacagattacttt

SEQ ID NO: 2413 - DNA, 20 bp, synthetic construct
  source 1..20: mol_type = other DNA
gtattaaaagaatgcaagag

SEQ ID NO: 2414 - DNA, 20 bp, synthetic construct
  source 1..20: mol_type = other DNA
cactggtattaaaagaatgc

SEQ ID NO: 2415 - DNA, 20 bp, synthetic construct
  source 1..20: mol_type = other DNA
taaggaaaatacattgtttc

SEQ ID NO: 2416 - DNA, 20 bp, synthetic construct
  source 1..20: mol_type = other DNA
tgagaaaaactattcataag

SEQ ID NO: 2417 - DNA, 20 bp, synthetic construct
  source 1..20: mol_type = other DNA
atgagaaaaactattcataa

SEQ ID NO: 2418 - DNA, 20 bp, synthetic construct
  source 1..20: mol_type = other DNA
accatgagaaaaactattca

SEQ ID NO: 2419 - DNA, 20 bp, synthetic construct
  source 1..20: mol_type = other DNA
taaatacaccatgagaaaaa

SEQ ID NO: 2420 - DNA, 20 bp, synthetic construct
  source 1..20: mol_type = other DNA
ataaatacaccatgagaaaa

SEQ ID NO: 2421 - DNA, 20 bp, synthetic construct
  source 1..20: mol_type = other DNA
gaataaatacaccatgagaa

SEQ ID NO: 2422 - DNA, 20 bp, synthetic construct
  source 1..20: mol_type = other DNA
aagaataaatacaccatgag

SEQ ID NO: 2423 - DNA, 20 bp, synthetic construct
  source 1..20: mol_type = other DNA
aaagaataaatacaccatga

SEQ ID NO: 2424 - DNA, 20 bp, synthetic construct
  source 1..20: mol_type = other DNA
aaaagaataaatacaccatg

SEQ ID NO: 2425 - DNA, 20 bp, synthetic construct
  source 1..20: mol_type = other DNA
acttaaaagaataaatacac

SEQ ID NO: 2426 - DNA, 20 bp, synthetic construct
  source 1..20: mol_type = other DNA
gtgaagtatatttaaaaaac

SEQ ID NO: 2427 - DNA, 20 bp, synthetic construct
  source 1..20: mol_type = other DNA
tgaaacattcaaaagtgaag

SEQ ID NO: 2428 - DNA, 20 bp, synthetic construct
  source 1..20: mol_type = other DNA
gctgtctgaaacattcaaaa

SEQ ID NO: 2429 - DNA, 20 bp, synthetic construct
  source 1..20: mol_type = other DNA
actctgtcctgataggtccc

SEQ ID NO: 2430 - DNA, 20 bp, synthetic construct
  source 1..20: mol_type = other DNA
gaactctgtcctgataggtc

SEQ ID NO: 2431 - DNA, 20 bp, synthetic construct
  source 1..20: mol_type = other DNA
ccaagtgctcctgaactggt

SEQ ID NO: 2432 - DNA, 20 bp, synthetic construct
  source 1..20: mol_type = other DNA
tagatcactcccaagtgctc

SEQ ID NO: 2433 - DNA, 20 bp, synthetic construct
  source 1..20: mol_type = other DNA
acctagatcactcccaagtg

SEQ ID NO: 2434 - DNA, 20 bp, synthetic construct
  source 1..20: mol_type = other DNA
cacctagatcactcccaagt

SEQ ID NO: 2435 - DNA, 20 bp, synthetic construct
  source 1..20: mol_type = other DNA
atcacctagatcactcccaa

SEQ ID NO: 2436 - DNA, 20 bp, synthetic construct
  source 1..20: mol_type = other DNA
catcacctagatcactccca

SEQ ID NO: 2437 - DNA, 20 bp, synthetic construct
  source 1..20: mol_type = other DNA
agcatcacctagatcactcc

SEQ ID NO: 2438 - DNA, 20 bp, synthetic construct
  source 1..20: mol_type = other DNA
tagcatcacctagatcactc

SEQ ID NO: 2439 - DNA, 20 bp, synthetic construct
  source 1..20: mol_type = other DNA
catagcatcacctagatcac

SEQ ID NO: 2440 - DNA, 20 bp, synthetic construct
  source 1..20: mol_type = other DNA
cacagctgcctgaagcatgt

SEQ ID NO: 2441 - DNA, 20 bp, synthetic construct
  source 1..20: mol_type = other DNA
tcacagctgcctgaagcatg

SEQ ID NO: 2442 - DNA, 20 bp, synthetic construct
  source 1..20: mol_type = other DNA
gtcacagctgcctgaagcat

SEQ ID NO: 2443 - DNA, 20 bp, synthetic construct
  source 1..20: mol_type = other DNA
ggtcacagctgcctgaagca

SEQ ID NO: 2444 - DNA, 20 bp, synthetic construct
  source 1..20: mol_type = other DNA
tggtcacagctgcctgaagc

SEQ ID NO: 2445 - DNA, 20 bp, synthetic construct
  source 1..20: mol_type = other DNA
atggtcacagctgcctgaag

SEQ ID NO: 2446 - DNA, 20 bp, synthetic construct
  source 1..20: mol_type = other DNA
acatggtcacagctgcctga

SEQ ID NO: 2447 - DNA, 20 bp, synthetic construct
  source 1..20: mol_type = other DNA
agacatggtcacagctgcct

SEQ ID NO: 2448 - DNA, 20 bp, synthetic construct
  source 1..20: mol_type = other DNA
aagacatggtcacagctgcc

SEQ ID NO: 2449 - DNA, 20 bp, synthetic construct
  source 1..20: mol_type = other DNA
aaagacatggtcacagctgc

SEQ ID NO: 2450 - DNA, 20 bp, synthetic construct
  source 1..20: mol_type = other DNA
taaagacatggtcacagctg

SEQ ID NO: 2451 - DNA, 20 bp, synthetic construct
  source 1..20: mol_type = other DNA
ctaaagacatggtcacagct

SEQ ID NO: 2452 - DNA, 20 bp, synthetic construct
  source 1..20: mol_type = other DNA
tttctaaagacatggtcaca

SEQ ID NO: 2453 - DNA, 20 bp, synthetic construct
  source 1..20: mol_type = other DNA
gtttctaaagacatggtcac

SEQ ID NO: 2454 - DNA, 20 bp, synthetic construct
  source 1..20: mol_type = other DNA
acagtttctaaagacatggt

SEQ ID NO: 2455 - DNA, 20 bp, synthetic construct
  source 1..20: mol_type = other DNA
gacagtttctaaagacatgg

SEQ ID NO: 2456 - DNA, 20 bp, synthetic construct
  source 1..20: mol_type = other DNA
tgacagtttctaaagacatg

SEQ ID NO: 2457 - DNA, 20 bp, synthetic construct
  source 1..20: mol_type = other DNA
ctgacagtttctaaagacat

SEQ ID NO: 2458 - DNA, 20 bp, synthetic construct
  source 1..20: mol_type = other DNA
tctgacagtttctaaagaca

SEQ ID NO: 2459 - DNA, 20 bp, synthetic construct
  source 1..20: mol_type = other DNA
tcatttctgacagtttctaa

SEQ ID NO: 2460 - DNA, 20 bp, synthetic construct
  source 1..20: mol_type = other DNA
aaatcatttctgacagtttc

SEQ ID NO: 2461 - DNA, 20 bp, synthetic construct
  source 1..20: mol_type = other DNA
caaatcatttctgacagttt

SEQ ID NO: 2462 - DNA, 20 bp, synthetic construct
  source 1..20: mol_type = other DNA
tttcaaatcatttctgacag

SEQ ID NO: 2463 - DNA, 20 bp, synthetic construct
  source 1..20: mol_type = other DNA
ttttcaaatcatttctgaca

SEQ ID NO: 2464 - DNA, 20 bp, synthetic construct
  source 1..20: mol_type = other DNA
ccttacctagatcactccca

SEQ ID NO: 2465 - DNA, 20 bp, synthetic construct
  source 1..20: mol_type = other DNA
aaagcaaaaatcacatggag

SEQ ID NO: 2466 - DNA, 20 bp, synthetic construct
  source 1..20: mol_type = other DNA
gggaatgaagaataatgtaa

SEQ ID NO: 2467 - DNA, 20 bp, synthetic construct
  source 1..20: mol_type = other DNA
tcttaatatgattaaagagg

SEQ ID NO: 2468 - DNA, 20 bp, synthetic construct
  source 1..20: mol_type = other DNA
ttcttaatatgattaaagag

SEQ ID NO: 2469 - DNA, 20 bp, synthetic construct
  source 1..20: mol_type = other DNA
agattacaaatttacttaag

SEQ ID NO: 2470 - DNA, 20 bp, synthetic construct
  source 1..20: mol_type = other DNA
tagattacaaatttacttaa

SEQ ID NO: 2471 - DNA, 20 bp, synthetic construct
  source 1..20: mol_type = other DNA
agtagattacaaatttactt

SEQ ID NO: 2472 - DNA, 20 bp, synthetic construct
  source 1..20: mol_type = other DNA
aatttagtagattacaaatt

SEQ ID NO: 2473 - DNA, 20 bp, synthetic construct
  source 1..20: mol_type = other DNA
tccagggaaatttagtagat

SEQ ID NO: 2474 - DNA, 20 bp, synthetic construct
  source 1..20: mol_type = other DNA
tccttaatccagggaaattt

SEQ ID NO: 2475 - DNA, 20 bp, synthetic construct
  source 1..20: mol_type = other DNA
aactgctccttaatccaggg

SEQ ID NO: 2476 - DNA, 20 bp, synthetic construct
  source 1..20: mol_type = other DNA
gtaactgctccttaatccag

SEQ ID NO: 2477 - DNA, 20 bp, synthetic construct
  source 1..20: mol_type = other DNA
ttctagcaatcctctcctgc

SEQ ID NO: 2478 - DNA, 20 bp, synthetic construct
  source 1..20: mol_type = other DNA
ttaaattattatgttaaagt

SEQ ID NO: 2479 - DNA, 20 bp, synthetic construct
  source 1..20: mol_type = other DNA
tttaaattattatgttaaag

SEQ ID NO: 2480 - DNA, 20 bp, synthetic construct
  source 1..20: mol_type = other DNA
gtttaaattattatgttaaa

SEQ ID NO: 2481 - DNA, 20 bp, synthetic construct
  source 1..20: mol_type = other DNA
agtttaaattattatgttaa

SEQ ID NO: 2482 - DNA, 20 bp, synthetic construct
  source 1..20: mol_type = other DNA
aagtttaaattattatgtta

SEQ ID NO: 2483 - DNA, 20 bp, synthetic construct
  source 1..20: mol_type = other DNA
gaagtttaaattattatgtt

SEQ ID NO: 2484 - DNA, 20 bp, synthetic construct
  source 1..20: mol_type = other DNA
tgtgaagtttaaattattat

SEQ ID NO: 2485 - DNA, 20 bp, synthetic construct
  source 1..20: mol_type = other DNA
gactgtacaaattactgtga

SEQ ID NO: 2486 - DNA, 20 bp, synthetic construct
  source 1..20: mol_type = other DNA
gagactgtacaaattactgt

SEQ ID NO: 2487 - DNA, 20 bp, synthetic construct
  source 1..20: mol_type = other DNA
tactaatattcatgatttct

SEQ ID NO: 2488 - DNA, 20 bp, synthetic construct
  source 1..20: mol_type = other DNA
ctactaatattcatgatttc

SEQ ID NO: 2489 - DNA, 20 bp, synthetic construct
  source 1..20: mol_type = other DNA
ttcacctactaatattcatg

SEQ ID NO: 2490 - DNA, 20 bp, synthetic construct
  source 1..20: mol_type = other DNA
tttcacctactaatattcat

SEQ ID NO: 2491 - DNA, 20 bp, synthetic construct
  source 1..20: mol_type = other DNA
tttttcacctactaatattc

SEQ ID NO: 2492 - DNA, 20 bp, synthetic construct
  source 1..20: mol_type = other DNA
atttttcacctactaatatt

SEQ ID NO: 2493 - DNA, 20 bp, synthetic construct
  source 1..20: mol_type = other DNA
ctcaagtatttttcattttc

SEQ ID NO: 2494 - DNA, 20 bp, synthetic construct
  source 1..20: mol_type = other DNA
gattatactcaagtattttt

SEQ ID NO: 2495 - DNA, 20 bp, synthetic construct
  source 1..20: mol_type = other DNA
tagattatactcaagtattt

SEQ ID NO: 2496 - DNA, 20 bp, synthetic construct
  source 1..20: mol_type = other DNA
ttagattatactcaagtatt

SEQ ID NO: 2497 - DNA, 20 bp, synthetic construct
  source 1..20: mol_type = other DNA
tttagattatactcaagtat

SEQ ID NO: 2498 - DNA, 20 bp, synthetic construct
  source 1..20: mol_type = other DNA
ttatttagattatactcaag

SEQ ID NO: 2499 - DNA, 20 bp, synthetic construct
  source 1..20: mol_type = other DNA
tgttatttagattatactca

SEQ ID NO: 2500 - DNA, 20 bp, synthetic construct
  source 1..20: mol_type = other DNA
cccattgttatttagattat

SEQ ID NO: 2501 - DNA, 20 bp, synthetic construct
  source 1..20: mol_type = other DNA
agacatatttaaaccgagac

SEQ ID NO: 2502 - DNA, 20 bp, synthetic construct
  source 1..20: mol_type = other DNA
aagacatatttaaaccgaga

SEQ ID NO: 2503 - DNA, 20 bp, synthetic construct
  source 1..20: mol_type = other DNA
taagacatatttaaaccgag

SEQ ID NO: 2504 - DNA, 20 bp, synthetic construct
  source 1..20: mol_type = other DNA
ttaagacatatttaaaccga

SEQ ID NO: 2505 - DNA, 20 bp, synthetic construct
  source 1..20: mol_type = other DNA
ctaattggccaaagtttaag

SEQ ID NO: 2506 - DNA, 20 bp, synthetic construct
  source 1..20: mol_type = other DNA
aacttctactactaattggc

SEQ ID NO: 2507 - DNA, 20 bp, synthetic construct
  source 1..20: mol_type = other DNA
tctctcaacttctactacta

SEQ ID NO: 2508 - DNA, 20 bp, synthetic construct
  source 1..20: mol_type = other DNA
ttctctcaacttctactact

SEQ ID NO: 2509 - DNA, 20 bp, synthetic construct
  source 1..20: mol_type = other DNA
agttactttttctctcaact

SEQ ID NO: 2510 - DNA, 20 bp, synthetic construct
  source 1..20: mol_type = other DNA
tgcttataatttctttgtca

SEQ ID NO: 2511 - DNA, 20 bp, synthetic construct
  source 1..20: mol_type = other DNA
ctgcttataatttctttgtc

SEQ ID NO: 2512 - DNA, 20 bp, synthetic construct
  source 1..20: mol_type = other DNA
tctgcttataatttctttgt

SEQ ID NO: 2513 - DNA, 20 bp, synthetic construct
  source 1..20: mol_type = other DNA
ccttcacctttttattgagt

SEQ ID NO: 2514 - DNA, 20 bp, synthetic construct
  source 1..20: mol_type = other DNA
tttcaaatccttcacctttt

SEQ ID NO: 2515 - DNA, 20 bp, synthetic construct
  source 1..20: mol_type = other DNA
cttttcaaatccttcacctt

SEQ ID NO: 2516 - DNA, 20 bp, synthetic construct
  source 1..20: mol_type = other DNA
atatcttttcaaatccttca

SEQ ID NO: 2517 - DNA, 20 bp, synthetic construct
  source 1..20: mol_type = other DNA
ttcattaaagccatacctac

SEQ ID NO: 2518 - DNA, 20 bp, synthetic construct
  source 1..20: mol_type = other DNA
tacacttttacattcccatt

SEQ ID NO: 2519 - DNA, 20 bp, synthetic construct
  source 1..20: mol_type = other DNA
ttatcaaaaaaatgccaaac

SEQ ID NO: 2520 - DNA, 20 bp, synthetic construct
  source 1..20: mol_type = other DNA
tttatcaaaaaaatgccaaa

SEQ ID NO: 2521 - DNA, 20 bp, synthetic construct
  source 1..20: mol_type = other DNA
atttatcaaaaaaatgccaa

SEQ ID NO: 2522 - DNA, 20 bp, synthetic construct
  source 1..20: mol_type = other DNA
acatttatcaaaaaaatgcc

SEQ ID NO: 2523 - DNA, 20 bp, synthetic construct
  source 1..20: mol_type = other DNA
tacatttatcaaaaaaatgc

SEQ ID NO: 2524 - DNA, 20 bp, synthetic construct
  source 1..20: mol_type = other DNA
aagtatacatttatcaaaaa

SEQ ID NO: 2525 - DNA, 20 bp, synthetic construct
  source 1..20: mol_type = other DNA
tatgtgaacctaagttttct

SEQ ID NO: 2526 - DNA, 20 bp, synthetic construct
  source 1..20: mol_type = other DNA
gatataagtttttatgtgaa

SEQ ID NO: 2527 - DNA, 20 bp, synthetic construct
  source 1..20: mol_type = other DNA
aaggtctacatttaggcagt

SEQ ID NO: 2528 - DNA, 20 bp, synthetic construct
  source 1..20: mol_type = other DNA
ttgtgcattcattaactaaa

SEQ ID NO: 2529 - DNA, 20 bp, synthetic construct
  source 1..20: mol_type = other DNA
aggaatagaaaaaagtacca

SEQ ID NO: 2530 - DNA, 20 bp, synthetic construct
  source 1..20: mol_type = other DNA
ggctgtacttaaacaggagg

SEQ ID NO: 2531 - DNA, 20 bp, synthetic construct
  source 1..20: mol_type = other DNA
ttttatacaaatgttgaggt

SEQ ID NO: 2532 - DNA, 20 bp, synthetic construct
  source 1..20: mol_type = other DNA
tgttttatacaaatgttgag

SEQ ID NO: 2533 - DNA, 20 bp, synthetic construct
  source 1..20: mol_type = other DNA
ctcatgttttatacaaatgt

SEQ ID NO: 2534 - DNA, 20 bp, synthetic construct
  source 1..20: mol_type = other DNA
aagaaaatccagtccactcc

SEQ ID NO: 2535 - DNA, 20 bp, synthetic construct
  source 1..20: mol_type = other DNA
aaaagaaaatccagtccact

SEQ ID NO: 2536 - DNA, 20 bp, synthetic construct
  source 1..20: mol_type = other DNA
tctaaaggtttttatcttgc

SEQ ID NO: 2537 - DNA, 20 bp, synthetic construct
  source 1..20: mol_type = other DNA
cttattatctaaaggttttt

SEQ ID NO: 2538 - DNA, 20 bp, synthetic construct
  source 1..20: mol_type = other DNA
agaagtgtaccttatgactt

SEQ ID NO: 2539 - DNA, 20 bp, synthetic construct
  source 1..20: mol_type = other DNA
agtgttatcacctcctggag

SEQ ID NO: 2540 - DNA, 20 bp, synthetic construct
  source 1..20: mol_type = other DNA
ggagtgttatcacctcctgg

SEQ ID NO: 2541 - DNA, 20 bp, synthetic construct
  source 1..20: mol_type = other DNA
cagagagatgcctatgtatt

SEQ ID NO: 2542 - DNA, 20 bp, synthetic construct
  source 1..20: mol_type = other DNA
ggagtgaaagtccaggtttc

SEQ ID NO: 2543 - DNA, 20 bp, synthetic construct
  source 1..20: mol_type = other DNA
catcttccaatttagcaagc

SEQ ID NO: 2544 - DNA, 20 bp, synthetic construct
  source 1..20: mol_type = other DNA
gaatcttatttacatcttcc

SEQ ID NO: 2545 - DNA, 20 bp, synthetic construct
  source 1..20: mol_type = other DNA
tgaatcttatttacatcttc

SEQ ID NO: 2546 - DNA, 20 bp, synthetic construct
  source 1..20: mol_type = other DNA
gtgaatcttatttacatctt

SEQ ID NO: 2547 - DNA, 20 bp, synthetic construct
  source 1..20: mol_type = other DNA
atgtgaatcttatttacatc

SEQ ID NO: 2548 - DNA, 20 bp, synthetic construct
  source 1..20: mol_type = other DNA
attttcaattaaatcctgaa

SEQ ID NO: 2549 - DNA, 20 bp, synthetic construct
  source 1..20: mol_type = other DNA
gtgattttcaattaaatcct

SEQ ID NO: 2550 - DNA, 20 bp, synthetic construct
  source 1..20: mol_type = other DNA
ctgacacaaatttagatgga

SEQ ID NO: 2551 - DNA, 20 bp, synthetic construct
  source 1..20: mol_type = other DNA
cagtgttcagaaatctgact

SEQ ID NO: 2552 - DNA, 20 bp, synthetic construct
  source 1..20: mol_type = other DNA
ccttctggcctttatgatct

SEQ ID NO: 2553 - DNA, 20 bp, synthetic construct
  source 1..20: mol_type = other DNA
gagaaattcctttagccatt

SEQ ID NO: 2554 - DNA, 20 bp, synthetic construct
  source 1..20: mol_type = other DNA
agagaaattcctttagccat

SEQ ID NO: 2555 - DNA, 20 bp, synthetic construct
  source 1..20: mol_type = other DNA
tagagaaattcctttagcca

SEQ ID NO: 2556 - DNA, 20 bp, synthetic construct
  source 1..20: mol_type = other DNA
ttagagaaattcctttagcc

SEQ ID NO: 2557 - DNA, 20 bp, synthetic construct
  source 1..20: mol_type = other DNA
ccaaaattacttcttttatc

SEQ ID NO: 2558 - DNA, 20 bp, synthetic construct
  source 1..20: mol_type = other DNA
ttccaaaattacttctttta

SEQ ID NO: 2559 - DNA, 20 bp, synthetic construct
  source 1..20: mol_type = other DNA
gttccaaaattacttctttt

SEQ ID NO: 2560 - DNA, 20 bp, synthetic construct
  source 1..20: mol_type = other DNA
tgttccaaaattacttcttt

SEQ ID NO: 2561 - DNA, 20 bp, synthetic construct
  source 1..20: mol_type = other DNA
atgttccaaaattacttctt

SEQ ID NO: 2562 - DNA, 20 bp, synthetic construct
  source 1..20: mol_type = other DNA
ctgatgttccaaaattactt

SEQ ID NO: 2563 - DNA, 20 bp, synthetic construct
  source 1..20: mol_type = other DNA
ttttactctttttattgttc

SEQ ID NO: 2564 - DNA, 20 bp, synthetic construct
  source 1..20: mol_type = other DNA
cccatattttactcttttta

SEQ ID NO: 2565 - DNA, 20 bp, synthetic construct
  source 1..20: mol_type = other DNA
tacccatattttactctttt

SEQ ID NO: 2566 - DNA, 20 bp, synthetic construct
  source 1..20: mol_type = other DNA
tagaaaattcaaaaggaggg

SEQ ID NO: 2567 - DNA, 20 bp, synthetic construct
  source 1..20: mol_type = other DNA
catcatacaatttagaaaat

SEQ ID NO: 2568 - DNA, 20 bp, synthetic construct
  source 1..20: mol_type = other DNA
ttgcttcaaccatcatacaa

SEQ ID NO: 2569 - DNA, 20 bp, synthetic construct
  source 1..20: mol_type = other DNA
ctataattcttgcttcaacc

SEQ ID NO: 2570 - DNA, 20 bp, synthetic construct
  source 1..20: mol_type = other DNA
actgaaaaccaaatcagtgc

SEQ ID NO: 2571 - DNA, 20 bp, synthetic construct
  source 1..20: mol_type = other DNA
atactgaaaaccaaatcagt

SEQ ID NO: 2572 - DNA, 20 bp, synthetic construct
  source 1..20: mol_type = other DNA
tatatactgaaaaccaaatc

SEQ ID NO: 2573 - DNA, 20 bp, synthetic construct
  source 1..20: mol_type = other DNA
ccttaaatatttccaatata

SEQ ID NO: 2574 - DNA, 20 bp, synthetic construct
  source 1..20: mol_type = other DNA
ataatgccttaaatatttcc

SEQ ID NO: 2575 - DNA, 20 bp, synthetic construct
  source 1..20: mol_type = other DNA
ccctttatatcctttgaccc

SEQ ID NO: 2576 - DNA, 20 bp, synthetic construct
  source 1..20: mol_type = other DNA
gttacctccctttatatcct

SEQ ID NO: 2577 - DNA, 20 bp, synthetic construct
  source 1..20: mol_type = other DNA
aaggttacctccctttatat

SEQ ID NO: 2578 - DNA, 20 bp, synthetic construct
  source 1..20: mol_type = other DNA
gaaaggttacctccctttat

SEQ ID NO: 2579 - DNA, 20 bp, synthetic construct
  source 1..20: mol_type = other DNA
agaaaggttacctcccttta

SEQ ID NO: 2580 - DNA, 20 bp, synthetic construct
  source 1..20: mol_type = other DNA
agaaatatagaaaggttacc

SEQ ID NO: 2581 - DNA, 20 bp, synthetic construct
  source 1..20: mol_type = other DNA
gcatcagtacaaaagaaata

SEQ ID NO: 2582 - DNA, 20 bp, synthetic construct
  source 1..20: mol_type = other DNA
atagtgaaattattttccaa

SEQ ID NO: 2583 - DNA, 20 bp, synthetic construct
  source 1..20: mol_type = other DNA
gtttttaaacaaatagtgaa

SEQ ID NO: 2584 - DNA, 20 bp, synthetic construct
  source 1..20: mol_type = other DNA
ttcagtttttaaacaaatag

SEQ ID NO: 2585 - DNA, 20 bp, synthetic construct
  source 1..20: mol_type = other DNA
gttcagtttttaaacaaata

SEQ ID NO: 2586 - DNA, 20 bp, synthetic construct
  source 1..20: mol_type = other DNA
ttcagcaattaaagactttt

SEQ ID NO: 2587 - DNA, 20 bp, synthetic construct
  source 1..20: mol_type = other DNA
caaatattagccaaagaggc

SEQ ID NO: 2588 - DNA, 20 bp, synthetic construct
  source 1..20: mol_type = other DNA
ataatgatcttccaggctgg

SEQ ID NO: 2589 - DNA, 20 bp, synthetic construct
  source 1..20: mol_type = other DNA
ctaaataatgatcttccagg

SEQ ID NO: 2590 - DNA, 20 bp, synthetic construct
  source 1..20: mol_type = other DNA
aggactaaataatgatcttc

SEQ ID NO: 2591 - DNA, 20 bp, synthetic construct
  source 1..20: mol_type = other DNA
atataaatttctatttttgg

SEQ ID NO: 2592 - DNA, 20 bp, synthetic construct
  source 1..20: mol_type = other DNA
aatataaatttctatttttg

SEQ ID NO: 2593 - DNA, 20 bp, synthetic construct
  source 1..20: mol_type = other DNA
cagtagagtattacatgcta

SEQ ID NO: 2594 - DNA, 20 bp, synthetic construct
  source 1..20: mol_type = other DNA
ctttttaatcctgacagtag

SEQ ID NO: 2595 - DNA, 20 bp, synthetic construct
  source 1..20: mol_type = other DNA
ggtttctttttaatcctgac

SEQ ID NO: 2596 - DNA, 20 bp, synthetic construct
  source 1..20: mol_type = other DNA
tgggtttctttttaatcctg

SEQ ID NO: 2597 - DNA, 20 bp, synthetic construct
  source 1..20: mol_type = other DNA
cccctgagatccagccacgg

SEQ ID NO: 2598 - DNA, 20 bp, synthetic construct
  source 1..20: mol_type = other DNA
agctgtcatttttagttgaa

SEQ ID NO: 2599 - DNA, 20 bp, synthetic construct
  source 1..20: mol_type = other DNA
gttctctatctctatacagc

SEQ ID NO: 2600 - DNA, 20 bp, synthetic construct
  source 1..20: mol_type = other DNA
agtggaaaccactaatatgt

SEQ ID NO: 2601 - DNA, 20 bp, synthetic construct
  source 1..20: mol_type = other DNA
acccactttctctaactagt

SEQ ID NO: 2602 - DNA, 20 bp, synthetic construct
  source 1..20: mol_type = other DNA
ctgctatcgatttatattcc

SEQ ID NO: 2603 - DNA, 20 bp, synthetic construct
  source 1..20: mol_type = other DNA
gttataataccacaaagatc

SEQ ID NO: 2604 - DNA, 20 bp, synthetic construct
  source 1..20: mol_type = other DNA
tgttataataccacaaagat

SEQ ID NO: 2605 - DNA, 20 bp, synthetic construct
  source 1..20: mol_type = other DNA
agtgttataataccacaaag

SEQ ID NO: 2606 - DNA, 20 bp, synthetic construct
  source 1..20: mol_type = other DNA
aagtgttataataccacaaa

SEQ ID NO: 2607 - DNA, 20 bp, synthetic construct
  source 1..20: mol_type = other DNA
gaagtgttataataccacaa

SEQ ID NO: 2608 - DNA, 20 bp, synthetic construct
  source 1..20: mol_type = other DNA
agacatagaagtgttataat

SEQ ID NO: 2609 - DNA, 20 bp, synthetic construct
  source 1..20: mol_type = other DNA
tacaatcaagacatagaagt

SEQ ID NO: 2610 - DNA, 20 bp, synthetic construct
  source 1..20: mol_type = other DNA
tacatggcattttatcacac

SEQ ID NO: 2611 - DNA, 20 bp, synthetic construct
  source 1..20: mol_type = other DNA
ttatatgtagttctacatgg

SEQ ID NO: 2612 - DNA, 20 bp, synthetic construct
  source 1..20: mol_type = other DNA
caaactaaaacctagatatt

SEQ ID NO: 2613 - DNA, 20 bp, synthetic construct
  source 1..20: mol_type = other DNA
gatcaaactaaaacctagat

SEQ ID NO: 2614 - DNA, 20 bp, synthetic construct
  source 1..20: mol_type = other DNA
agatcaaactaaaacctaga

SEQ ID NO: 2615 - DNA, 20 bp, synthetic construct
  source 1..20: mol_type = other DNA
aaagatcaaactaaaaccta

SEQ ID NO: 2616 - DNA, 20 bp, synthetic construct
  source 1..20: mol_type = other DNA
actaaagatcaaactaaaac

SEQ ID NO: 2617 - DNA, 20 bp, synthetic construct
  source 1..20: mol_type = other DNA
taactaaagatcaaactaaa

SEQ ID NO: 2618 - DNA, 20 bp, synthetic construct
  source 1..20: mol_type = other DNA
gtaactaaagatcaaactaa

SEQ ID NO: 2619 - DNA, 20 bp, synthetic construct
  source 1..20: mol_type = other DNA
tttgcccaatttcacccaat

SEQ ID NO: 2620 - DNA, 20 bp, synthetic construct
  source 1..20: mol_type = other DNA
agttgtaaagatatttaaga

SEQ ID NO: 2621 - DNA, 20 bp, synthetic construct
  source 1..20: mol_type = other DNA
aaacccaactttctattttg

SEQ ID NO: 2622 - DNA, 20 bp, synthetic construct
  source 1..20: mol_type = other DNA
ttacaaaaacccaactttct

SEQ ID NO: 2623 - DNA, 20 bp, synthetic construct
  source 1..20: mol_type = other DNA
tttacaaaaacccaactttc

SEQ ID NO: 2624 - DNA, 20 bp, synthetic construct
  source 1..20: mol_type = other DNA
gtatttacaaaaacccaact

SEQ ID NO: 2625 - DNA, 20 bp, synthetic construct
  source 1..20: mol_type = other DNA
atgtatttacaaaaacccaa

SEQ ID NO: 2626 - DNA, 20 bp, synthetic construct
  source 1..20: mol_type = other DNA
aattcatgtatttacaaaaa

SEQ ID NO: 2627 - DNA, 20 bp, synthetic construct
  source 1..20: mol_type = other DNA
gtgtatatcaacaattcatg

SEQ ID NO: 2628 - DNA, 20 bp, synthetic construct
  source 1..20: mol_type = other DNA
ttgtgtatatcaacaattca

SEQ ID NO: 2629 - DNA, 20 bp, synthetic construct
  source 1..20: mol_type = other DNA
gatagccaccagtatattct

SEQ ID NO: 2630 - DNA, 20 bp, synthetic construct
  source 1..20: mol_type = other DNA
ccagatagccaccagtatat

SEQ ID NO: 2631 - DNA, 20 bp, synthetic construct
  source 1..20: mol_type = other DNA
tccccatttcctaatcccag

SEQ ID NO: 2632 - DNA, 20 bp, synthetic construct
  source 1..20: mol_type = other DNA
ccccagaaaattcccccatg

SEQ ID NO: 2633 - DNA, 20 bp, synthetic construct
  source 1..20: mol_type = other DNA
gatacacaaccattccattg

SEQ ID NO: 2634 - DNA, 20 bp, synthetic construct
  source 1..20: mol_type = other DNA
atcaagatacacaaccattc

SEQ ID NO: 2635 - DNA, 20 bp, synthetic construct
  source 1..20: mol_type = other DNA
tttgacaaatacaccatcaa

SEQ ID NO: 2636 - DNA, 20 bp, synthetic construct
  source 1..20: mol_type = other DNA
gttctatatattttgacaaa

SEQ ID NO: 2637 - DNA, 20 bp, synthetic construct
  source 1..20: mol_type = other DNA
tagttctatatattttgaca

SEQ ID NO: 2638 - DNA, 20 bp, synthetic construct
  source 1..20: mol_type = other DNA
ttatagttctatatattttg

SEQ ID NO: 2639 - DNA, 20 bp, synthetic construct
  source 1..20: mol_type = other DNA
acttttatagttctatatat

SEQ ID NO: 2640 - DNA, 20 bp, synthetic construct
  source 1..20: mol_type = other DNA
cacgagtttctttttttgat

SEQ ID NO: 2641 - DNA, 20 bp, synthetic construct
  source 1..20: mol_type = other DNA
aatgtatttctatttgagca

SEQ ID NO: 2642 - DNA, 20 bp, synthetic construct
  source 1..20: mol_type = other DNA
caaagtcatcaaaaggcaag

SEQ ID NO: 2643 - DNA, 20 bp, synthetic construct
  source 1..20: mol_type = other DNA
attctcaaagtcatcaaaag

SEQ ID NO: 2644 - DNA, 20 bp, synthetic construct
  source 1..20: mol_type = other DNA
gaaaattctcaaagtcatca

SEQ ID NO: 2645 - DNA, 20 bp, synthetic construct
  source 1..20: mol_type = other DNA
ttccagaaaattctcaaagt

SEQ ID NO: 2646 - DNA, 20 bp, synthetic construct
  source 1..20: mol_type = other DNA
catttctttaaaatttccag

SEQ ID NO: 2647 - DNA, 20 bp, synthetic construct
  source 1..20: mol_type = other DNA
accacatttctttaaaattt

SEQ ID NO: 2648 - DNA, 20 bp, synthetic construct
  source 1..20: mol_type = other DNA
aaacaaaaccacatttcttt

SEQ ID NO: 2649 - DNA, 20 bp, synthetic construct
  source 1..20: mol_type = other DNA
gaaacaaaaccacatttctt

SEQ ID NO: 2650 - DNA, 20 bp, synthetic construct
  source 1..20: mol_type = other DNA
ggaaacaaaaccacatttct

SEQ ID NO: 2651 - DNA, 20 bp, synthetic construct
  source 1..20: mol_type = other DNA
gggaaacaaaaccacatttc

SEQ ID NO: 2652 - DNA, 20 bp, synthetic construct
  source 1..20: mol_type = other DNA
ttgggaaacaaaaccacatt

SEQ ID NO: 2653 - DNA, 20 bp, synthetic construct
  source 1..20: mol_type = other DNA
gttgggaaacaaaaccacat

SEQ ID NO: 2654 - DNA, 20 bp, synthetic construct
  source 1..20: mol_type = other DNA
gcattgcttataactttctc

SEQ ID NO: 2655 - DNA, 20 bp, synthetic construct
  source 1..20: mol_type = other DNA
ggcattgcttataactttct

SEQ ID NO: 2656 - DNA, 20 bp, synthetic construct
  source 1..20: mol_type = other DNA
taaaccactgaatagagaaa

SEQ ID NO: 2657 - DNA, 20 bp, synthetic construct
  source 1..20: mol_type = other DNA
agttaaaccactgaatagag

SEQ ID NO: 2658 - DNA, 20 bp, synthetic construct
  source 1..20: mol_type = other DNA
aagttaaaccactgaataga

SEQ ID NO: 2659 - DNA, 20 bp, synthetic construct
  source 1..20: mol_type = other DNA
tcaagttaaaccactgaata

SEQ ID NO: 2660 - DNA, 20 bp, synthetic construct
  source 1..20: mol_type = other DNA
ttcaagttaaaccactgaat

SEQ ID NO: 2661 - DNA, 20 bp, synthetic construct
  source 1..20: mol_type = other DNA
aattcaagttaaaccactga

SEQ ID NO: 2662 - DNA, 20 bp, synthetic construct
  source 1..20: mol_type = other DNA
caaagcagttaaatctggcc

SEQ ID NO: 2663 - DNA, 20 bp, synthetic construct
  source 1..20: mol_type = other DNA
tgggtttatatatttttctt

SEQ ID NO: 2664 - DNA, 20 bp, synthetic construct
  source 1..20: mol_type = other DNA
tgtgggtttatatatttttc

SEQ ID NO: 2665 - DNA, 20 bp, synthetic construct
  source 1..20: mol_type = other DNA
taatccaatgaatgcatctc

SEQ ID NO: 2666 - DNA, 20 bp, synthetic construct
  source 1..20: mol_type = other DNA
aagtcactgttatattagtt

SEQ ID NO: 2667 - DNA, 20 bp, synthetic construct
  source 1..20: mol_type = other DNA
gcatgtaaagtcactgttat

SEQ ID NO: 2668 - DNA, 20 bp, synthetic construct
  source 1..20: mol_type = other DNA
aaaaaaaacccatagcatgt

SEQ ID NO: 2669 - DNA, 20 bp, synthetic construct
  source 1..20: mol_type = other DNA
gaaaaaaaacccatagcatg

SEQ ID NO: 2670 - DNA, 20 bp, synthetic construct
  source 1..20: mol_type = other DNA
agaaaaaaaacccatagcat

SEQ ID NO: 2671 - DNA, 20 bp, synthetic construct
  source 1..20: mol_type = other DNA
gaggagaaaaaaaacccata

SEQ ID NO: 2672 - DNA, 20 bp, synthetic construct
  source 1..20: mol_type = other DNA
atttcttgaagatgagagga

SEQ ID NO: 2673 - DNA, 20 bp, synthetic construct
  source 1..20: mol_type = other DNA
agcagattcctgacactgtg

SEQ ID NO: 2674 - DNA, 20 bp, synthetic construct
  source 1..20: mol_type = other DNA
gagcagattcctgacactgt

SEQ ID NO: 2675 - DNA, 20 bp, synthetic construct
  source 1..20: mol_type = other DNA
aattatacagaaagagcaga

SEQ ID NO: 2676 - DNA, 20 bp, synthetic construct
  source 1..20: mol_type = other DNA
acaattatacagaaagagca

SEQ ID NO: 2677 - DNA, 20 bp, synthetic construct
  source 1..20: mol_type = other DNA
taacaattatacagaaagag

SEQ ID NO: 2678 - DNA, 20 bp, synthetic construct
  source 1..20: mol_type = other DNA
gtaacaattatacagaaaga

SEQ ID NO: 2679 - DNA, 20 bp, synthetic construct
  source 1..20: mol_type = other DNA
tgtaacaattatacagaaag

SEQ ID NO: 2680 - DNA, 20 bp, synthetic construct
  source 1..20: mol_type = other DNA
ctgtaacaattatacagaaa

SEQ ID NO: 2681 - DNA, 20 bp, synthetic construct
  source 1..20: mol_type = other DNA
cctgtaacaattatacagaa

SEQ ID NO: 2682 - DNA, 20 bp, synthetic construct
  source 1..20: mol_type = other DNA
tcctgtaacaattatacaga

SEQ ID NO: 2683 - DNA, 20 bp, synthetic construct
  source 1..20: mol_type = other DNA
aggatgagatacaaggtcaa

SEQ ID NO: 2684 - DNA, 20 bp, synthetic construct
  source 1..20: mol_type = other DNA
acataaagccattatgtcag

SEQ ID NO: 2685 - DNA, 20 bp, synthetic construct
  source 1..20: mol_type = other DNA
tacataaagccattatgtca

SEQ ID NO: 2686 - DNA, 20 bp, synthetic construct
  source 1..20: mol_type = other DNA
gtacataaagccattatgtc

SEQ ID NO: 2687 - DNA, 20 bp, synthetic construct
  source 1..20: mol_type = other DNA
agccatgtacataaagccat

SEQ ID NO: 2688 - DNA, 20 bp, synthetic construct
  source 1..20: mol_type = other DNA
aaaaaccaccttgtagctag

SEQ ID NO: 2689 - DNA, 20 bp, synthetic construct
  source 1..20: mol_type = other DNA
aataaaaaccaccttgtagc

SEQ ID NO: 2690 - DNA, 20 bp, synthetic construct
  source 1..20: mol_type = other DNA
gaataaaaaccaccttgtag

SEQ ID NO: 2691 - DNA, 20 bp, synthetic construct
  source 1..20: mol_type = other DNA
agaataaaaaccaccttgta

SEQ ID NO: 2692 - DNA, 20 bp, synthetic construct
  source 1..20: mol_type = other DNA
cagaataaaaaccaccttgt

SEQ ID NO: 2693 - DNA, 20 bp, synthetic construct
  source 1..20: mol_type = other DNA
cccagaataaaaaccacctt

SEQ ID NO: 2694 - DNA, 20 bp, synthetic construct
  source 1..20: mol_type = other DNA
acccagaataaaaaccacct

SEQ ID NO: 2695 - DNA, 20 bp, synthetic construct
  source 1..20: mol_type = other DNA
catggcaacccagaataaaa

SEQ ID NO: 2696 - DNA, 20 bp, synthetic construct
  source 1..20: mol_type = other DNA
gcatggcaacccagaataaa

SEQ ID NO: 2697 - DNA, 20 bp, synthetic construct
  source 1..20: mol_type = other DNA
ctggaacacttttaaaaaat

SEQ ID NO: 2698 - DNA, 20 bp, synthetic construct
  source 1..20: mol_type = other DNA
tttcttactcccctatgccc

SEQ ID NO: 2699 - DNA, 20 bp, synthetic construct
  source 1..20: mol_type = other DNA
ttccactttcttactcccct

SEQ ID NO: 2700 - DNA, 20 bp, synthetic construct
  source 1..20: mol_type = other DNA
tttccactttcttactcccc

SEQ ID NO: 2701 - DNA, 20 bp, synthetic construct
  source 1..20: mol_type = other DNA
atgtgaatatcctgcctcca

SEQ ID NO: 2702 - DNA, 20 bp, synthetic construct
  source 1..20: mol_type = other DNA
accttattcagccagagttg

SEQ ID NO: 2703 - DNA, 20 bp, synthetic construct
  source 1..20: mol_type = other DNA
gcaaccttattcagccagag

SEQ ID NO: 2704 - DNA, 20 bp, synthetic construct
  source 1..20: mol_type = other DNA
gcccatactttccaggtgcc

SEQ ID NO: 2705 - DNA, 20 bp, synthetic construct
  source 1..20: mol_type = other DNA
gagcccatactttccaggtg

SEQ ID NO: 2706 - DNA, 20 bp, synthetic construct
  source 1..20: mol_type = other DNA
tactggagcccatactttcc

SEQ ID NO: 2707 - DNA, 20 bp, synthetic construct
  source 1..20: mol_type = other DNA
ccctttaccacttttgtgca

SEQ ID NO: 2708 - DNA, 20 bp, synthetic construct
  source 1..20: mol_type = other DNA
catccctttaccacttttgt

SEQ ID NO: 2709 - DNA, 20 bp, synthetic construct
  source 1..20: mol_type = other DNA
catgacagccaagatgccag

SEQ ID NO: 2710 - DNA, 20 bp, synthetic construct
  source 1..20: mol_type = other DNA
ttagcatttctcttctgttg

SEQ ID NO: 2711 - DNA, 20 bp, synthetic construct
  source 1..20: mol_type = other DNA
tgttgctttcctttcctgca

SEQ ID NO: 2712 - DNA, 20 bp, synthetic construct
  source 1..20: mol_type = other DNA
gatttcagtctacatctaac

SEQ ID NO: 2713 - DNA, 20 bp, synthetic construct
  source 1..20: mol_type = other DNA
tcctgatttcagtctacatc

SEQ ID NO: 2714 - DNA, 20 bp, synthetic construct
  source 1..20: mol_type = other DNA
acctcctgatttcagtctac

SEQ ID NO: 2715 - DNA, 20 bp, synthetic construct
  source 1..20: mol_type = other DNA
agttttaaccacacctcctg

SEQ ID NO: 2716 - DNA, 20 bp, synthetic construct
  source 1..20: mol_type = other DNA
aaagagttttaaccacacct

SEQ ID NO: 2717 - DNA, 20 bp, synthetic construct
  source 1..20: mol_type = other DNA
agcctctttcaaagagtttt

SEQ ID NO: 2718 - DNA, 20 bp, synthetic construct
  source 1..20: mol_type = other DNA
tctgaaattaataatggtgt

SEQ ID NO: 2719 - DNA, 20 bp, synthetic construct
  source 1..20: mol_type = other DNA
gctctgaaattaataatggt

SEQ ID NO: 2720 - DNA, 20 bp, synthetic construct
  source 1..20: mol_type = other DNA
gccttgttttcttccaagaa

SEQ ID NO: 2721 - DNA, 20 bp, synthetic construct
  source 1..20: mol_type = other DNA
acaaaacatcaagaattcta

SEQ ID NO: 2722 - DNA, 20 bp, synthetic construct
  source 1..20: mol_type = other DNA
caacaaaacatcaagaattc

SEQ ID NO: 2723 - DNA, 20 bp, synthetic construct
  source 1..20: mol_type = other DNA
tcaacaaaacatcaagaatt

SEQ ID NO: 2724 - DNA, 20 bp, synthetic construct
  source 1..20: mol_type = other DNA
ttcaacaaaacatcaagaat

SEQ ID NO: 2725 - DNA, 20 bp, synthetic construct
  source 1..20: mol_type = other DNA
gttttcaacaaaacatcaag

SEQ ID NO: 2726 - DNA, 20 bp, synthetic construct
  source 1..20: mol_type = other DNA
tgttttcaacaaaacatcaa

SEQ ID NO: 2727 - DNA, 20 bp, synthetic construct
  source 1..20: mol_type = other DNA
cttctgttttcaacaaaaca

SEQ ID NO: 2728 - DNA, 20 bp, synthetic construct
  source 1..20: mol_type = other DNA
tgcttctgttttcaacaaaa

SEQ ID NO: 2729 - DNA, 20 bp, synthetic construct
  source 1..20: mol_type = other DNA
gaatctttctaaaacttacc

SEQ ID NO: 2730 - DNA, 20 bp, synthetic construct
  source 1..20: mol_type = other DNA
agaatctttctaaaacttac

SEQ ID NO: 2731 - DNA, 20 bp, synthetic construct
  source 1..20: mol_type = other DNA
tacagaatctttctaaaact

SEQ ID NO: 2732 - DNA, 20 bp, synthetic construct
  source 1..20: mol_type = other DNA
gtaccaagattatattgcct

SEQ ID NO: 2733 - DNA, 20 bp, synthetic construct
  source 1..20: mol_type = other DNA
tgtaccaagattatattgcc

SEQ ID NO: 2734 - DNA, 20 bp, synthetic construct
  source 1..20: mol_type = other DNA
ttgtaccaagattatattgc

SEQ ID NO: 2735 - DNA, 20 bp, synthetic construct
  source 1..20: mol_type = other DNA
atgttgtaccaagattatat

SEQ ID NO: 2736 - DNA, 20 bp, synthetic construct
  source 1..20: mol_type = other DNA
aaatgttgtaccaagattat

SEQ ID NO: 2737 - DNA, 20 bp, synthetic construct
  source 1..20: mol_type = other DNA
aagtcttattcattgcagct

SEQ ID NO: 2738 - DNA, 20 bp, synthetic construct
  source 1..20: mol_type = other DNA
taagtcttattcattgcagc

SEQ ID NO: 2739 - DNA, 20 bp, synthetic construct
  source 1..20: mol_type = other DNA
tctgaatttctaagcattag

SEQ ID NO: 2740 - DNA, 20 bp, synthetic construct
  source 1..20: mol_type = other DNA
ttctgaatttctaagcatta

SEQ ID NO: 2741 - DNA, 20 bp, synthetic construct
  source 1..20: mol_type = other DNA
tttctgaatttctaagcatt

SEQ ID NO: 2742 - DNA, 20 bp, synthetic construct
  source 1..20: mol_type = other DNA
gactttaaaatttagtctga

SEQ ID NO: 2743 - DNA, 20 bp, synthetic construct
  source 1..20: mol_type = other DNA
gtagactttaaaatttagtc

SEQ ID NO: 2744 - DNA, 20 bp, synthetic construct
  source 1..20: mol_type = other DNA
agtagactttaaaatttagt

SEQ ID NO: 2745 - DNA, 20 bp, synthetic construct
  source 1..20: mol_type = other DNA
aagtagactttaaaatttag

SEQ ID NO: 2746 - DNA, 20 bp, synthetic construct
  source 1..20: mol_type = other DNA
tcaaaatgaatttatttatg

SEQ ID NO: 2747 - DNA, 20 bp, synthetic construct
  source 1..20: mol_type = other DNA
catcaaaatgaatttattta

SEQ ID NO: 2748 - DNA, 20 bp, synthetic construct
  source 1..20: mol_type = other DNA
gaaaaccatcaaaatgaatt

SEQ ID NO: 2749 - DNA, 20 bp, synthetic construct
  source 1..20: mol_type = other DNA
tgagaaaaccatcaaaatga

SEQ ID NO: 2750 - DNA, 20 bp, synthetic construct
  source 1..20: mol_type = other DNA
ctgagaaaaccatcaaaatg

SEQ ID NO: 2751 - DNA, 20 bp, synthetic construct
  source 1..20: mol_type = other DNA
tctgagaaaaccatcaaaat

SEQ ID NO: 2752 - DNA, 20 bp, synthetic construct
  source 1..20: mol_type = other DNA
tgttctgagaaaaccatcaa

SEQ ID NO: 2753 - DNA, 20 bp, synthetic construct
  source 1..20: mol_type = other DNA
tttccattactcaagcagtg

SEQ ID NO: 2754 - DNA, 20 bp, synthetic construct
  source 1..20: mol_type = other DNA
aaagacatacaagtttgata

SEQ ID NO: 2755 - DNA, 20 bp, synthetic construct
  source 1..20: mol_type = other DNA
agttaaaagacatacaagtt

SEQ ID NO: 2756 - DNA, 20 bp, synthetic construct
  source 1..20: mol_type = other DNA
aagttaaaagacatacaagt

SEQ ID NO: 2757 - DNA, 20 bp, synthetic construct
  source 1..20: mol_type = other DNA
tggtgggtacataaggttca

SEQ ID NO: 2758 - DNA, 20 bp, synthetic construct
  source 1..20: mol_type = other DNA
aggaactgataattgttgaa

SEQ ID NO: 2759 - DNA, 20 bp, synthetic construct
  source 1..20: mol_type = other DNA
gtgaaacaagaattgtcagg

SEQ ID NO: 2760 - DNA, 20 bp, synthetic construct
  source 1..20: mol_type = other DNA
gcttcaaaataatggaagtt

SEQ ID NO: 2761 - DNA, 20 bp, synthetic construct
  source 1..20: mol_type = other DNA
tgcttcaaaataatggaagt

SEQ ID NO: 2762 - DNA, 20 bp, synthetic construct
  source 1..20: mol_type = other DNA
gtgcttcaaaataatggaag

SEQ ID NO: 2763 - DNA, 20 bp, synthetic construct
  source 1..20: mol_type = other DNA
tgtgcttcaaaataatggaa

SEQ ID NO: 2764 - DNA, 20 bp, synthetic construct
  source 1..20: mol_type = other DNA
atgtgcttcaaaataatgga

SEQ ID NO: 2765 - DNA, 20 bp, synthetic construct
  source 1..20: mol_type = other DNA
cttaataaataatgtgataa

SEQ ID NO: 2766 - DNA, 20 bp, synthetic construct
  source 1..20: mol_type = other DNA
aacttaataaataatgtgat

SEQ ID NO: 2767 - DNA, 20 bp, synthetic construct
  source 1..20: mol_type = other DNA
aaacttaataaataatgtga

SEQ ID NO: 2768 - DNA, 20 bp, synthetic construct
  source 1..20: mol_type = other DNA
ctatgtcctaaaagtttctc

SEQ ID NO: 2769 - DNA, 20 bp, synthetic construct
  source 1..20: mol_type = other DNA
gctatgtcctaaaagtttct

SEQ ID NO: 2770 - DNA, 20 bp, synthetic construct
  source 1..20: mol_type = other DNA
aattaacataaaagctatgt

SEQ ID NO: 2771 - DNA, 20 bp, synthetic construct
  source 1..20: mol_type = other DNA
gtaattaacataaaagctat

SEQ ID NO: 2772 - DNA, 20 bp, synthetic construct
  source 1..20: mol_type = other DNA
aagtaattaacataaaagct

SEQ ID NO: 2773 - DNA, 20 bp, synthetic construct
  source 1..20: mol_type = other DNA
tagtgcagaaattaagtaat

SEQ ID NO: 2774 - DNA, 20 bp, synthetic construct
  source 1..20: mol_type = other DNA
ggatggctagtgcagaaatt

SEQ ID NO: 2775 - DNA, 20 bp, synthetic construct
  source 1..20: mol_type = other DNA
ctagtgcagaaaattagaag

SEQ ID NO: 2776 - DNA, 20 bp, synthetic construct
  source 1..20: mol_type = other DNA
ggatagctagtgcagaaaat

SEQ ID NO: 2777 - DNA, 20 bp, synthetic construct
  source 1..20: mol_type = other DNA
agaatgagacatgtaagtat

SEQ ID NO: 2778 - DNA, 20 bp, synthetic construct
  source 1..20: mol_type = other DNA
ggtgaaaaagaatgagacat

SEQ ID NO: 2779 - DNA, 20 bp, synthetic construct
  source 1..20: mol_type = other DNA
cctgggtgaaaaagaatgag

SEQ ID NO: 2780 - DNA, 20 bp, synthetic construct
  source 1..20: mol_type = other DNA
cacctgggtgaaaaagaatg

SEQ ID NO: 2781 - DNA, 20 bp, synthetic construct
  source 1..20: mol_type = other DNA
aacaaaaattatctagatcc

SEQ ID NO: 2782 - DNA, 20 bp, synthetic construct
  source 1..20: mol_type = other DNA
gttgagtttttatatttgat

SEQ ID NO: 2783 - DNA, 20 bp, synthetic construct
  source 1..20: mol_type = other DNA
gggttgagtttttatatttg

SEQ ID NO: 2784 - DNA, 20 bp, synthetic construct
  source 1..20: mol_type = other DNA
aagatactactatagcatag

SEQ ID NO: 2785 - DNA, 20 bp, synthetic construct
  source 1..20: mol_type = other DNA
gaagatactactatagcata

SEQ ID NO: 2786 - DNA, 20 bp, synthetic construct
  source 1..20: mol_type = other DNA
ggaagatactactatagcat

SEQ ID NO: 2787 - DNA, 20 bp, synthetic construct
  source 1..20: mol_type = other DNA
tggaagatactactatagca

SEQ ID NO: 2788 - DNA, 18 bp, synthetic construct
  source 1..18: mol_type = other DNA
gcatcttttcatactggc

SEQ ID NO: 2789 - DNA, 18 bp, synthetic construct
  source 1..18: mol_type = other DNA
gcaatctggcagatcacc

SEQ ID NO: 2790 - DNA, 18 bp, synthetic construct
  source 1..18: mol_type = other DNA
gtcttaaaatatttagct

SEQ ID NO: 2791 - DNA, 18 bp, synthetic construct
  source 1..18: mol_type = other DNA
ggtagctcatcaattcaa

SEQ ID NO: 2792 - DNA, 18 bp, synthetic construct
  source 1..18: mol_type = other DNA
agccattaatctatactg

SEQ ID NO: 2793 - DNA, 15 bp, synthetic construct
  source 1..15: mol_type = other DNA
ataggtcccgctgct

SEQ ID NO: 2794 - DNA, 16 bp, synthetic construct
  source 1..16: mol_type = other DNA
tgataggtcccgctgc

SEQ ID NO: 2795 - DNA, 16 bp, synthetic construct
  source 1..16: mol_type = other DNA
ctgataggtcccgctg

SEQ ID NO: 2796 - DNA, 15 bp, synthetic construct
  source 1..15: mol_type = other DNA
ctgataggtcccgct

SEQ ID NO: 2797 - DNA, 14 bp, synthetic construct
  source 1..14: mol_type = other DNA
ctgataggtcccgc

SEQ ID NO: 2798 - DNA, 24 bp, synthetic construct
  source 1..24: mol_type = other DNA
tgacacagacatcaggtacaaatc

SEQ ID NO: 2799 - DNA, 17 bp, synthetic construct
  source 1..17: mol_type = other DNA
tgctgctgttgctgctt

SEQ ID NO: 2800 - DNA, 25 bp, synthetic construct
  source 1..25: mol_type = other DNA
agcttcggaagagacgagaagccta

SEQ ID NO: 2801 - DNA, 15 bp, synthetic construct
  source 1..15: mol_type = other DNA
tcgccgcttgctgca

SEQ ID NO: 2802 - DNA, 17 bp, synthetic construct
  source 1..17: mol_type = other DNA
atcggccgtgatgtcga

SEQ ID NO: 2803 - DNA, 23 bp, synthetic construct
  source 1..23: mol_type = other DNA
ccatggtcaaccccaccgtgttc

SEQ ID NO: 2804 - DNA, 19 bp, synthetic construct
  source 1..19: mol_type = other DNA
gaaggtgaaggtcggagtc

SEQ ID NO: 2805 - DNA, 20 bp, synthetic construct
  source 1..20: mol_type = other DNA
gaagatggtgatgggatttc

SEQ ID NO: 2806 - DNA, 20 bp, synthetic construct
  source 1..20: mol_type = other DNA
caagcttcccgttctcagcc

SEQ ID NO: 2807 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphodiester
  modified_base 4: mod_base = OTHER; note = 2'-MOE 5-methyl cytidine 3'-phosphodiester
  modified_base 5: mod_base = OTHER; note = 2'-MOE adenosine 3'-phosphorothioate
  modified_base 6..8: mod_base = OTHER; note = 2'-deoxythymidine 3'-phosphorothioate
  modified_base 9: mod_base = OTHER; note = 2'-deoxyadenosine 3'-phosphorothioate
  modified_base 10..11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphodiester
  modified_base 17: mod_base = OTHER; note = 2'-MOE guanosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
gctcatttattctcaagtac

SEQ ID NO: 2808 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphodiester
  modified_base 4: mod_base = OTHER; note = 2'-MOE 5-methyl cytidine 3'-phosphodiester
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphodiester
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE adenosine
gcaccatatatatctcagaa

SEQ ID NO: 2809 - DNA, 20 bp, synthetic construct
  source 1..20: mol_type = other DNA
  modified_base 1: mod_base = OTHER; note = 2'-MOE guanosine 3'-phosphorothioate
  modified_base 2..3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9..13: mod_base = OTHER; note = 2'-deoxythymidine 3'-phosphorothioate
  modified_base 14..15: mod_base = OTHER; note = 5-methyl 2'-deoxycytidine 3'-phosphorothioate
  modified_base 16: mod_base = OTHER; note = 2'-MOE adenosine 3'-phosphodiester
  modified_base 17: mod_base = OTHER; note = 2'-MOE guanosine 3'-phosphodiester
  modified_base 18..19: mod_base = OTHER; note = 2'-MOE 5-methyl cytidine 3'-phosphorothioate
  modified_base 20: mod_base = OTHER; note = 2'-MOE thymidine
gttaatactttttccagcct

---

The invention claimed is:

1. An oligomeric compound comprising a modified oligonucleotide consisting of 12 to 50 linked nucleosides and having a nucleobase sequence comprising a portion of at least 8 contiguous nucleobases, wherein the portion is

18. The oligomeric compound of claim 1, wherein the modified oligonucleotide has a sugar motif comprising:

a 5'-region consisting of 1-6 linked 5'-nucleosides;

a central region consisting of 6-10 linked central region nucleosides; and a 3'-region consisting of 1-6 linked 5'-nucleosides; wherein each of the 5'-region nucleosides and each of the 3'-region nucleosides comprises a modified sugar moiety and each of the central region nucleosides comprises a 2'-deoxyribosyl sugar moiety.

19. The oligomeric compound of claim 1, wherein the modified oligonucleotide consists of 18-20 linked nucleosides.

20. The oligomeric compound of claim 1, wherein the modified oligonucleotide consists of 20 linked nucleosides.

21. The oligomeric compound of claim 1 comprising a conjugate group comprising a conjugate moiety and a conjugate linker.

22. An oligomeric duplex comprising the oligomeric compound of claim 1.

23. A modified oligonucleotide consisting of 12 to 50 linked nucleosides and having a nucleobase sequence comprising at least 8 contiguous nucleobases of any of the nucleobase sequences of SEQ ID NOs: 2233-2237, wherein the modified oligonucleotide comprises at least one modification selected from a modified sugar moiety and a modified internucleoside linkage.

24. A pharmaceutical composition comprising the oligomeric compound of claim 1 and a pharmaceutically acceptable carrier or diluent.

25. The pharmaceutical composition of claim 24, wherein the pharmaceutically acceptable diluent is artificial cerebrospinal fluid or phosphate-buffered saline (PBS).

26. The pharmaceutical composition of claim 25, wherein the pharmaceutical composition consists essentially of the oligomeric compound and artificial cerebrospinal fluid.

27. The pharmaceutical composition of claim 25, wherein the pharmaceutical composition consists essentially of the oligomeric compound and PBS.

28. The modified oligonucleotide of claim 23, wherein the modified sugar moiety comprises a bicyclic sugar moiety or a non-bicyclic sugar moiety.

29. The modified oligonucleotide of claim 23, wherein the modified internucleoside linkage is a phosphorothioate internucleoside linkage.

30. The oligomeric compound of claim 1, wherein the modified oligonucleotide has a nucleobase sequence comprising a portion of at least 10 contiguous nucleobases, wherein the portion is complementary to an equal length portion of nucleobases 34440-34486 of SEQ ID NO: 2.

31. The modified oligonucleotide of claim 23, wherein the modified oligonucleotide has a nucleobase sequence comprising at least 10 contiguous nucleobases of any of the nucleobase sequences of SEQ ID NOs: 2233-2237.

32. The modified oligonucleotide of claim 23, wherein the modified oligonucleotide has a nucleobase sequence comprising at least 12 contiguous nucleobases of any of the nucleobase sequences of SEQ ID NOs: 2233-2237.

33. The modified oligonucleotide of claim 23, wherein the modified oligonucleotide has a nucleobase sequence comprising at least 16 contiguous nucleobases of any of the nucleobase sequences of SEQ ID NOs: 2233-2237.

34. The modified oligonucleotide of claim 23, wherein the modified oligonucleotide has a nucleobase sequence comprising at least 18 contiguous nucleobases of any of the nucleobase sequences of SEQ ID NOs: 2233-2237.

35. The modified oligonucleotide of claim 23, wherein the modified oligonucleotide has a nucleobase sequence comprising at least 20 contiguous nucleobases of any of the nucleobase sequences of SEQ ID NOs: 2233-2237.

36. The oligomeric compound of claim 1, wherein the modified oligonucleotide has a nucleobase sequence comprising a portion of at least 12 contiguous nucleobases, wherein the portion is fully complementary to an equal length portion of nucleobases 34440-34486 of SEQ ID NO: 2.

37. The oligomeric compound of claim 1, wherein the modified oligonucleotide has a nucleobase sequence comprising a portion of at least 16 contiguous nucleobases, wherein the portion is fully complementary to an equal length portion of nucleobases 34440-34486 of SEQ ID NO: 2.

38. The oligomeric compound of claim 1, wherein the modified oligonucleotide has a nucleobase sequence comprising a portion of at least 18 contiguous nucleobases, wherein the portion is fully complementary to an equal length portion of nucleobases 34440-34486 of SEQ ID NO: 2.

39. The oligomeric compound of claim 1, wherein the modified oligonucleotide has a nucleobase sequence comprising a portion of at least 20 contiguous nucleobases, wherein the portion is fully complementary to an equal length portion of nucleobases 34440-34486 of SEQ ID NO: 2.

* * * * *